(12) United States Patent
Blattner et al.

(10) Patent No.: US 6,365,723 B1
(45) Date of Patent: Apr. 2, 2002

(54) **SEQUENCES OF *E. COLI* O157**

(75) Inventors: Frederick R. Blattner, Madison; Valerie Burland, Cross Plains; Nicole T. Perna, Madison; Guy Plunkett, Madison; Rod Welch, Madison, all of WI (US)

(73) Assignee: Wisconsin Alumni Research Foundation, Madison, WI (US)

( * ) Notice: Subject to any disclaimer, the term of this patent is extended or adjusted under 35 U.S.C. 154(b) by 0 days.

(21) Appl. No.: 09/453,702

(22) Filed: Dec. 3, 1999

(51) Int. Cl.[7] .......................... C07H 21/02; C07H 21/04
(52) U.S. Cl. ................. 536/23.1; 536/24.3; 536/24.31; 536/24.32; 536/24.33
(58) Field of Search .............................. 536/23.1, 24.3, 536/24.31, 24.32, 24.33

(56) References Cited

U.S. PATENT DOCUMENTS 5,798,260 A    8/1998   Tarr et al. ................. 435/252.3

FOREIGN PATENT DOCUMENTS

WO      WO 98/22575      * 5/1998

OTHER PUBLICATIONS

Perna, et al., "Complete Sequence of the Locus of Enterocyte Effacement from Enterohemorrhagic *Escherichia coli* O157:H7 and Comparison with Enteropathogenic *E. coli* E2348/69".

Posfai, et al., "Versatile Insertion Plasmids for Targeted Genome Manipulations in Bacteria: Isolation, Deletion, and Rescue of the Pathogenicity Island LEE of the *Escherichia coli* 0157:H7 Genome," *Journal of Bacteriology* 179:4426–4428 (1997).

* cited by examiner

*Primary Examiner*—Jeffrey Fredman
(74) *Attorney, Agent, or Firm*—Quarles & Brady LLP

(57) ABSTRACT

The entire genome of pathogenic *E. coli* strain O157:H7 has been sequenced. All of the genomic DNA sequences present in O157 and absent in the previously sequenced laboratory strain K12 are presented here.

2 Claims, No Drawings

SEQUENCES OF E. COLI O157

CROSS-REFERENCE TO RELATED APPLICATION

Not applicable.

STATEMENT REGARDING FEDERALLY SPONSORED RESEARCH OR DEVELOPMENT

This invention was made with United States government support awarded by N1H-A141329. The U.S. has certain rights in this invention.

BACKGROUND OF THE INVENTION

*Escherichia coli* is a common enteric bacterial strain that has both laboratory and human health importance. One particular strain of *E. coli,* designated O157:H7 is a human enteric pathogen that causes acute hemorrhagic colitis. Young children and the elderly are particularly susceptible to disease caused by this bacteria, which is usually contracted by eating contaminated food such as undercooked meat. In the most vulnerable patients, the colitis frequently develops into hemolytic uremic syndrome (HUS), a condition that is often fatal. The disease has a very rapid progression, and is consequently very difficult to treat. Often, patients are severely ill by the time the disease is diagnosed. Once a diagnosis has been made, appropriate antibiotics may be administered to kill the infective bacteria. Sometimes, however, by the time a diagnosis has been rendered, toxic proteins secreted by the bacteria have damaged mucosal cells and entered the blood stream. Recently, clinical isolates of O157:H7 have been found to exhibit resistance to an increasing spectrum of antibiotics, which will further complicate treatment.

The source of the bacteria in the several recent cases of disease caused by this organism were traced to hamburgers purchased in fast food restaurants. The bacteria are extremely proficient at establishing an infection; ingestion of as few as 10 live bacteria is sufficient to establish an infection. The highly infective nature of O157:H7 and the devastating sequelae associated with infection by this bacteria, together with the extensive public attention given to outbreaks of hemorrhagic colitis, has generated a great deal of interest among medical professionals and the general public in developing the means for early diagnosis and treatment of the disease. Farmers are desirous of an effective treatment of infections in cattle and pigs, which are the main reservoirs for *E. coli* enteric pathogens. The ability to diagnose and treat livestock infected by this organism will prevent the loss of livestock and the transmission of the organism from animals to humans. Meat suppliers and those in the food industry are very much interested in a means for detecting the organism in tainted meat. Because the infective dose of O157:H7 is extremely low, a highly sensitive test is needed to identify contaminating organisms in food.

Modern geneticists have been working to resolve the genetic code of many organisms. Efforts to sequence the human genome are ongoing. The effort to sequence the genomes of whole organisms began with an effort to sequence the genome of *E. coli.* For the original effort to sequence the *E. coli* genome, a useful and common laboratory strain, designated K12, was chosen. The entire genome of that strain was sequenced and published. *Science,* 277:1453–1462 (1997). Since the genes which are responsible for the pathogenicity of *E. coli* O157:H7 are missing from strain K12, the sequence of the K12 genome is of limited help in developing tools to detect, hinder or destroy *E. coli* 0157:H7.

Some efforts have been directed toward the sequencing of specific genes from 0157:H7. U.S. Pat. No. 5,798,260 describes the sequence of one specific gene, named adhesion, from that genome. The development of additional sequence information from *E. coli* 0157:H7 would be needed for comprehensive efforts at detection, diagnosis, prophylaxis and therapeutic approaches to infections caused by the organism.

BRIEF SUMMARY OF THE INVENTION

It is an object of the invention to provide essentially the entire sequence of *E. coli* 0157:H7 to enable detection, diagnosis, prophylaxis and therapeutic tools to combat bacterial infections.

It is another object of the present invention to provide a means to detect low numbers of *Escherichia coli* 0157:H7 in a contaminated food source.

It is yet another object of this invention to provide a means for the early diagnosis of humans and livestock infected with 0157:H7.

Another object of the present invention is to provide a means of treating humans and livestock infected with 0157:H7.

It is a further object of the present invention to provide a means for the prevention of infection by 0157:H7.

The present invention includes many DNA sequences that are unique to *E. coli* 0157:H7.

One aspect of the present invention is a DNA sequence comprising an open reading frame (ORF), designated 03169, that encodes a putative cytotoxin 3169 amino acids in length that resembles the clostridial cytotoxins ToxA and ToxB of *C. difficile* and cytotoxin L of *C. sordelli.*

Another aspect of the present invention is a DNA sequence that constitutes an urease gene cluster.

A third aspect of the present invention is a chromosomal gene that encodes a toxin related to the RTX family of cytotoxins and associated transport proteins.

Another aspect of the present invention are genes that are found in the Locus of Enterocyte Effacement (LEE), a 45-kb cluster of genes that are involved in the attachment of pathogens to intestinal epithelial cells and other related functions necessary to establish infection.

Another aspect of the present invention is a hypothetical serine/threonine kinase (stk) encoded by phage 933W, a lysogenic bacteriophage found in 0157:H7.

The present invention is also a putative tail fiber gene, which is found on phage 933W.

Another aspect of the present invention is a method for detecting *E. coli* 0157:H7 and distinguishing the strain from other strains of *E. coli* by genetic analysis and testing.

It is a feature of the invention disclosed here that virtually the entire genome of *E. coli* 0157:H7 is set forth in the data contained here, combined with the information already published in the field.

BRIEF DESCRIPTION OF THE SEVERAL VIEWS OF THE DRAWINGS

Not applicable.

DETAILED DESCRIPTION OF THE INVENTION

The investigators here have sequenced virtually the entire genome of *E. coli* 0157:H7. Presented in this specification is essentially all the DNA sequence which is contained in strain O157:H7 and not found in the prviously sequenced *E. coli* strain K12. The genome sequence is essentially complete, lacking only an occasional presumably small sequence linkage between established long sequences known. The availability of the sequence data presented here will enable intelligent design of diagnostic detection, prophylaxis and therapeutic tools for disease and infections caused by this organisms.

The sequence of *E. coli* O157:H7 was, in brief, performed by shotgun cloning in the M13 Janus vector (Burland et al. *Nucl. Acids Res.* 21:3385–3390 (1993)). Genomic DNA was prepared for library construction by nebulization, end-repair and size fractionation as described in Mahillon et al. *Gene* 223:47–54 (1998). Recovered DNA fragments were ligated into the M13 Janus vectors. Library subclones were picked as plaques, from which template DNAs were prepared and then sequenced by Prism-terminator Cycle Sequencing chemistry and analyzed on ABI377 automated sequencers. Sequences were assembled by the Seqman II program (DNASTAR), and finishing employed a combination of PCR and primer walking techniques. Open reading frames were identified and analyzed as described in Blattner et al. *Science* 277:1453–1474 (1997). All the sequences presented in this specification are unique to strain O157:H7 as compared to strain K12. This sequence data, when combined with the sequence of K12, resolves all of the genetic sequence of O157:H7. The information on the K12 sequence, contained in *Science,* 277:1453–62 (1997) is hereby incorporated by reference as if set forth in full herein.

An important analysis which has been begun on this sequence data is the identification of genetic sequences associated with the pathogenesis of infection, which sequences provide information essential to the diagnosis, treatment, and prevention of infection by that organism. In order to facilitate the identification of genes involved in the pathogenesis of infection by enterohemorrhagic *E. coli* (EHEC) for use in detection of the pathogen, and in the diagnosis, treatment, and prevention of enterohemorrhagic infections, the entire genomic DNA sequence of *E. coli* O157:H7 serovar EDL933 (ATCC 43895) was determined and compared with that of *E. coli* K-12, a nonpathogenic laboratory strain, as described in detail in the examples below.

Surprisingly, the genome of O157:H7 was found to be more than one million base pairs larger than that of K-12 and to have up to 1000 genes not found on K-12. These additional gene sequences are distributed throughout more than 250 sites in islands, with each island containing from zero to sixty genes. An unexpected finding is that many of the new genes resemble virulence determinants from a wide variety of pathogens, ranging from *Helicobacter pylori* to *Clostridium difficile.* Numerous sequences of interest were identified in the genome of *E. coli* O157:H7, including chromosomal, plasmid, and phage sequences.

Attached to this patent application is a sequence listing containing essentially all of the DNA sequence of the regions in the O157 genome that are not present in the K12 genome. This sequence is present in the sequence listing as SEQ ID:NO 1 through SEQ ID:NO 255. These sequences correspond to the 255 islands of O157 DNA that did are not found in K12 DNA. Each of those islands has been assigned an identification (an OZ identification, meaning in the O157 zone of the genome, as opposed to a K12 region). In the description of each of the sequences is a base pair listing of where that particular sequence is found in the underlying backbone of the entire O157 sequence.

Also included in this patent application are two tables intended to make available some of the genetic analysis which has been done on these sequences. Table 1 simply itemizes the O157 islands by OZ number and lists some of the presently known noteworthy features in the sequenced islands. Table 2 is a listing of the open reading frames (ORFs) identified in each of the OZ sequences. Where the open reading frames have been matched to putative function, such an indication is found matched to the open reading frame in Table 2. The protein encoding by each such ORF can be determined by appropriate conversion of the open reading frame DNA sequence to protein amino acid sequence using the genetic code.

By definition, the genetic material in the OZ sequences described here are sufficient for pathogenocity in humans, since strain O157 is highly pathogenic while K12 is not. In addition, analysis of the open reading frames and computer comparisons to sequences from other pathogens had allowed identification of several of the open reading frames which code for proteins specifically associated with pathogenicity.

A gene encoding an unusually large ORF, designated o3169, which putatively encodes a 3169 amino acid protein, was identified on plasmid pO157, a 92 kb plasmid resident in *E. coli* O157:H7 in an autonomously replicating form. Data base searches revealed that the deduced amino acid sequence of this putative ORF is similar to the large clostridial cytotoxins, ToxA and ToxB of *C. difficile* (Dove et al., *Infect. Immun* 58:480–488 (1990); von Eichel-Streiber et al., *Mol. Gen. Genet.* 233:260–268 (1992)) and cytotoxin L of *C. sordelli* (Green et al. *Gene* 161:57–61, 1995). ToxA, ToxB, and cytotoxin L are 2710, 2366, and 2338 amino acid residues in length, respectively. The sequences of o3169 and its putative translation product are shown in SEQ ID NO:256 and SEQ ID NO:257, respectively.

The clostridial cytotoxins are homologous proteins with three domains (von Eichel-Streiber et al., *Trends in Microbiology* 4: 375–382 (1996)). The N-terminal region contains a catalytic domain, a glucosyltransferase that acts on small GTP-binding proteins to interfere with their function in the organization of cytoskeletal actin filaments (Just et al., *Nature* 375: 500–503 (1995)). The central region contains a translocation domain that directs the secretion of the toxin, and the C-terminal region contains a target binding site.

The amino acid identity between the translation product of o3169 and the known cytotoxins is relatively weak (20%) over 444 amino acids, to ToxB. However, the alignment of these sequences is striking. The region having the highest level of amino acid identity is the first (N-terminal) 700 amino acids, which corresponds to the catalytic site of the clostridial toxins.

ToxA damages intestinal mucosal cells, and when ToxA is present, ToxB gains access to the cells underlying the mucosa, causing further damage. By analogy, the putative cytotoxin encoded by o3169 may contribute to the damage to mucosal cells observed in enterohemorrhagic *E. coli* infections by acting alone or in concert with some other factor to destroy submucosal tissue, thereby causing or exacerbating the acute symptoms of infection. Therefore, the putative toxin is a promising target for treatment of persons infected by enterohemorrhagic *E. coli.* The administration of an antibody raised against the newly discovered toxin, or a portion of the toxin, could provide an effective treatment of severe symptoms of infection. The administration of the antitoxin could be used in conjunction with antibiotic therapy. Treatment with antibiotics is effective in controlling the infection itself. However, antibiotic therapy alone is ineffective in preventing or alleviating symptoms of the disease if the antibiotic is not administered in time to prevent the production of the toxin.

A cluster of seven genes very similar to the urease genes of numerous other bacterial pathogens has been identified on the chromosome of *E. coli* O157:H7 and its sequence determined (SEQ ID NO:258). Urease, or urea amidohydrolase, catalyzes the hydrolysis of urea to yield ammonia and carbamate. Expression of the urease genes in urogenital and gastroenteric bacteria is important in pathogenesis. For example, formation of ammonia by cell-surface bound urease in *Heliobacter pylori* is thought to cause a localized increase in pH allowing survival of the bacteria in the harshly acidic environment of the host's gastric system. In the gastrointestinal pathogens *Yersinia enterocolitica* and *Morganella morganii*, urease was found to be activated by low-pH conditions (Young et al., *J. Bacteriology* 178: 6487–6495 (1996)). The urease isolated from *Vibrio parahaemolyticus*, which causes gastroenteritis and traveler's diarrhea, has been found to cause intestinal fluid accumulation in suckling mice (Cai and Ni, *J. Clin. Lab. Analysis* 10(2): 70–73 (1996)). The presence of urea has been found to enhance intracellular survival of urease-positive *Bordatella bronchiseptica*, a mammalian respiratory pathogen (McMillan et al., *Microbial Pathogenesis* 21(5): 379–394 (1996)).

Gene order is conserved among most known bacterial urease clusters (Neyrolles et al., *J. Bacteriol.* 178(9): 2725 (1996)) and the urease gene cluster of *E. coli* O157:H7. The urease gene cluster begins with ureD, an accessory gene involved with regulation, followed by three structural genes, ureA, ureB, and ureC, and three accessory genes, ureE, ureF, and ureG. The latter three genes are believed to be involved in nickel metallocenter biosynthesis (Moncrief and Hausinger, *J. Bacteriol.* 178(18): 5417–5421 (1996)). In-frame stop codons prematurely terminate ureD (24 amino acids) and ureE (four amino acids) relative to the C-termini shared by most protein database entries. All 7 ORFs have from 70–96% identity to genes from *Klebsiella aerogenes* (Mulrooney and Hausinger, *J. Bacteriol.* 172(10): 5837–5843 (1990)). It is of interest that the sequence of strain EDL933 is more similar to the urease cluster of Klebsiella than that of *E. coli* strain 1440, the only other *E. coli* urease sequence presently available (D'Orazio and Collins, *J. Bacteriol.* 175(6): 1860–1864 (1993)). For example, ureD of EDL 933 is 71% identical to the corresponding gene from *Klebsiella aerogenes*, but only 47% identical to the plasmid borne ureD gene of *E. coli* 1440.

Some strains of *E. coli*, particularly the uropathogens, test positive for urease activity, but EDL933 does not. A urease-positive mutant strain of O157:H7 observed among U.S. clinical isolates (Hayes et al., *J. Clin. Microbiol.* 33(12): 3347–3348 (1995)) may reflect the activation of a cryptic operon. Alternatively, the urease-positive mutant strain of O157:H7 may reflect a regulatory change for an already functional operon. Analogously, urease-negative *Y. pestis* exhibits a urease gene complex very similar to those of urease-positive members of the Yersinia genus. (de Koning-Ward and Robins-Browne, *Gene* 182(1–2): 225–228 (1996)).

The urease gene cluster has potential utility in vaccine development. For example, the whole gene cluster could be genetically engineered into an attenuated strain to be used as a vaccine. The urease gene cluster would enhance the ability of the vaccine strain to survive the acid environment of the stomach.

An O157:H7 chromosomal gene cluster related to the RTX family of cytotoxins was identified as described in the examples below. The RTX cytotoxins are a group of exotoxins produced by Gram-negative bacteria that share the properties of secretion by a leader-independent pathway and a tandemly repeated sequence nine amino acids in length that is responsible for calcium binding (Welch et al., *FEMS Microbiol. Immunol.* 5: 29–36 (1992)). RTX toxins recognize a beta2 integrin on the surface of host cells (Lally et al., *J. Biol. Chem.* 272: 30463–30469 (1997)). Known members of the family include apxIA, apxIIA, and apxIIIA from *Actinobacillus pleuropneumoniae*, cyaA from *Bordetella pertussis*, frpA from *Neisseria meningitidis*, prtc from *Erwinia chrysanthemi*, hlyA and elyA from *Escherichia coli*, aaltA from *Actinobacillus actinomycetemcomitans*, and lktA from *Pasteurella haemolytica*. Hybridization studies using probes designed from sequences of these known toxins identified potential RTX toxin genes in several pathogenic bacterial species for which no RTX toxins were previously known, indicating that RTX or RTX-like toxins are widely distributed among pathogenic gram-negative bacteria (Kuhnert et al., *Appl. Environ. Microbiol.* 63: 2258–2265, (1997)). The novel O157:H7 toxin locus (SEQ ID NO:259 and SEQ ID NO:260) comprises three genes, including the putative toxin and two proteins involved in transport. The gene order and sizes are consistent with other RTX loci. The putative toxin gene shows only marginal similarity to other RTX toxins, and the match is limited to the glycine-rich calcium binding repeat region. The more highly conserved transport genes are approximately 40% identical to related genes found in other RTX clusters.

The Locus of Enterocyte Effacement (LEE) is a 45 kb cluster of genes involved in intimate adherence of pathogens to intestinal epithelial cells, initiation of host signal, transduction pathways, and formation of attaching and effacing lesions (McDaniel et al., *Proc. Natl. Acad. Sci.* 92: 1664–1668, (1995); McDaniel and Kaper, *Molecular Microbiology* 23: 399–407 (1997)). Colony hybridization studies indicate that sequences homologous to the entire element are found in numerous enteropathogenic *E. coli* (EPEC), enterohemorrhagic *E. coli* (EHEC), and other related bacteria (McDaniel et al., *Proc. Natl. Acad. Sci.* (1995)). The O157:H7 LEE sequence is shown in SEQ ID NO:261. Sequence data is currently available for the entire LEE from another EPEC strain E2348/69. Comparisons of the O157:H7 LEE to that of E2348/69 revealed that although many genes were nearly identical between the two strains, other genes are markedly variable. This variability is non-random with respect to gene function, in that all proteins known to be exported to the extracellular environment are variable, whereas those proteins known to constitute the secretion machinery are invariant. A similar observation has been made based on comparisons of the inv-spa complex of *Salmonella enterica* (Boyd et al. *J. Bacteriol.* 179: 1895–1991 (1997)).

Four contiguous LEE genes, L0027, L0028, L0029, and L0030, have been selected for their diagnostic potential. A comparison of these genes from EDL933 and the corresponding genes in E2348/9 revealed significant differences between the strains: L0027 (33.52% difference); L0028 (17.48%); L0029 (21.94%); and L0030 (25.30%). In E2348/69, the homolog of known L0027 is known as tir (B. Kenny et al., *Cell* 91: 511–520). The tir gene encodes a product that is translocated from the bacterium to the host cell where it serves as the receptor for intimin, another LEE encoded gene product. Little is known about the function and role in pathogenesis of the other three hypervariable virulence LEE genes. The L0028 gene product shows 27% identity with a hypothetical protein encoded in a Shigella virulence-associated cluster (Elliot et al, *Mol. Mircro.,* in press). The deduced amino acid sequence of the L0027 gene shows slight similarity to a secreted protein in the plant pathogen *Erwinia amylovora,* and the L0028 translational product has 27% identity with a hypothetical protein encoded in a Shigella virulence-associated cluster (Elliot et al. *Mol. Micro.,* in press).

The entire toxin-converting phage 933W was sequenced as described in the examples. Two novel gene sequences with potential diagnostic and therapeutic value were identified. The first is an ORF (SEQ ID NO:262) that encodes a protein (SEQ ID NO:263) that resembles members of the eukaryotic family of serine/threonine kinase (stk). The amino acid sequence similarities span the conserved regions in the catalytic domain of the eukaryotic protein kinases, including both the ATP binding and active site patterns as described in the PROSITE database. BLASTP, FASTA, and DeCypher II searches with the stk sequences all yield much higher scoring matches to the eukaryotic serine/threonine protein kinases than do searches with the YpkA protein of *Yersinia pseudotuberculosis* and *Y. enterocolitica.* There is some suggestion that the Yersinia protein kinase is involved in virulence, by interfering with the signal transduction pathway of the mammalian host, and bacteriophage 933W may interfere with the host systems in the same manner.

Shiga-like toxins, which are encoded by lysogenic bacteriophages, are considered to be one of the major pathogenic features of enterohaemorrhagic *E. coli* strains. Toxin genes have been previously sequenced in 933W. Based on the arrangement of the 933W and our knowledge of phage organization, we postulated that shiga-like toxin genes are "late genes" the expression of which is controlled by a homologue of the Q gene of bacteriophage lambda. If in fact the shiga-like toxin genes are late genes, the toxins would be expressed only during a lytic infection. Bacterial cells already carrying the prophage would be immune to super-infection by the phage released during a lytic phase of growth. However, non-lysogens in the vicinity could be infected and produce additional phage and toxin in what can be envisioned as an amplification by recruitment. Thus any late gene product could be an indicator of a condition under which toxin production would be increased. We have identified a putative tail fiber gene in the bacteriophage sequence. The coding region and the deduced amino acid sequence of the gene are shown in SEQ ID NO:264 and SEQ ID NO:265, respectively. The phage tail fibers, expressed by late genes, are required for infection of new bacterial hosts during the lytic phase of growth. Therefore, antibodies to this protein could serve as a diagnostic, as well as a therapeutic to prevent the proposed recruitment and infection of other bacterial cells.

Several other putative pathogenocity genes have been identified as well. The following is a list of additional pathogenic genes by reference to the segment (OZ number) and to the open reading frame (F0 number) in which the sequence for that pathogen gene is presented below.

Toxins
OZID_175 (F1037) homolog of Shigella SHeT
OZID_175 (F1041, F1042) putative *Clostridium difficile* ToxAB-like cytotoxin
OZID_11 (F0027) *Legionella pneumophila* IcmF-like homolog Fimbriae
Attachment to the host:
OZID_197 (F1133–F1139)
OZID_215 (F1231–F1237)
Both encode six proteins most similar to those of the lpfABCDE locus of Salmonella.

Iron Utilization
Iron is complexed in hemoglobin in the host so that infecting bacteria need efficient systems to actively acquire iron.
OZID_196 (F1124–F1132) chu locus homologous to the shu locus of *Shigella dysenteriae*
OZID_29 (F1132–F1134) homologous to the *Actinobacillus pleuropneumoniae* afuABC locus
OZID_176 (F1054–1059) a putative siderophore receptor and associated proteins plus one hypothetical protein, similar to FecD, FecC (both permeases) and FecE (ATP-binding protein) of Synechocystis.
OZID_78 (F0527 F0528), tonB-dependent outer membrane receptor, and ABC transporter
OZID_59 (F0294) putative exogenous ferric siderophore receptor similar to R4
OZID_62 (F0360) Salmonella IroE-like protein, Phage Encoded
OZID_98 (F0630) and OZID_139 (F0825), putative superoxide dismutases, potentially giving protection from oxidative stress Metabolic Capabilities
These may contribute to the ability to grow in the intestinal environment.
OZID_26 (F0125–F0131) high affinity ribose transport system
OZID_29 (F0135–F0137) hexose-phosphate transport
OZID_49 (F0167–F0179) includes glutamate fermentation, fumarase, ATP-transferase
OZID_59 (F0256–F0262) urease
OZID_62 (F0394–F0409) fatty acid/polyketide biosynthesis, interspersed unknowns
OZID_151 (F0921–F0925) sucrose utilization, D-serine permease part of 12 kb island
OZID_156 (F0932–F0934) DMSO reductase-anaerobic
OZID_193 (F1097–F1113) fatty acid biosynthesis
OZID_194 (F1115–F1123) PTS and sugar modification enzymes, substrate unknown
OZID_232 (F1266–F1272) PTS sorbose
OZID_233 (F1274–F1282) sugar (ribose) transport, modification One wishing to practice the present invention using one of the disclosed sequences could do so by isolating the sequence from ATCC 43895 using knowledge of the nucleotide sequence and standard methods known to one of skill in the art.

It is expected that minor sequence variations in *E. coli* O157:H7-specific nucleotide sequences associated with nucleotide additions, deletions, and mutations, whether naturally occurring or introduced in vitro, would not interfere with the usefulness of these sequences in the detection of enterohemorrhagic *E. coli,* in methods for preventing EHEC infection, and in methods for treating EHEC infection. Therefore, the scope of the present invention is intended to encompass minor variations in the claimed sequences.

By an *E. coli* O157:H7-specific nucleotide probe it is meant a sequence that is able to hybridize to *E. coli* O157:H7 target DNA present in a sample containing *E. coli* O157:H7 under suitable hybridization conditions and which does not hybridize with DNA from other *E. coli* strains or from other bacterial species. It is well within the ability of one skilled in the art to determine suitable hybridization conditions based on probe length, G+C content, and the degree of stringency required for a particular application.

The probe may be RNA or DNA. Depending on the detection means employed, the probe may be unlabeled, radiolabeled, or labeled with a dye. The probe may be hybridized with a sample that has been immobilized on a solid support such as nitrocellulose or a nylon membrane, or the probe may be immobilized on a solid support, such as a silicon chip.

The sample to be tested may include blood, urine, feces, or other materials from a human or a livestock animal. Alternatively, the sample may include food intended for human consumption. The sample may be tested directly, or may be treated in some manner prior to testing. For example, the sample may be subjected to PCR amplification using appropriate oligonucleotide primers.

Any means of detecting DNA-RNA or DNA-DNA hybridization known to the art may be used in the present invention.

Also presented in this specification is a series of sequence listings constituting the entire sequence of all portions of the genome of *E. coli* O157:H7 that do not appear in strain K12. These sequences are presented as SEQ:ID:NO:1 to SEQ:ID:NO:255 below. Since all of these sequences are diagnostic of 0157:H7, as compared to K12, sequence information from any of these sequences can be used to design diagnostic probes useful to distinguish strain 0157:H7 from strain K12 using molecular techniques. To have reasonable assurance of success under conditions of variable stringency, it is preferred that such diagnostic probes use sequences which are at least 25 nucleotides or longer in length. Any 25-mer selected from amongst any of the sequences in any of SEQ:ID:NO:1 through SEQ:ID:NO:255 may be used for such a probe.

EXAMPLES

Isolation and Cloning of DNA

A 45-Kb LEE was isolated from EDL933, an EHEC 0157:H7 serovar, using a homologous recombination driven targeting vector (Posfai et al. *J. Bacteriol.* 179: 4426–4428 (1997)). Briefly, a targeting vector, loaded with known chromosomal sequence flanking LEE, was used to introduce novel flp recombinase target sites by homologous recombination. Expression of flp from a helper plasmid promotes excision of the target as a small plasmid. The excised plasmid DNA was shotgun cloned into the Janus M13 vector (Burland et al., *Nucleic Acids Res.* 21:3385–3390 (1993)). The urease gene cluster and the RTX toxin locus were isolated and cloned in the same manner as LEE (Posfai et al. *J. Bacteriol.* 179:4426–4428 (1997)).

Phage 933W obtained from the supernatant of a liquid culture of *E. coli* O157:H7 serovar EDL933 was used to infect *E. coli* K-12 strain LE392 in liquid culture. Phage were propagated in *E. coli* K-12 strain LE392 and isolated using standard methods. Purifying the phage by standard methods including a CsCl-EtBr density gradient centrifugation step, and isolating the viral DNA. The viral DNA was sheared by nebulization and shotgun cloned into the Janus M13 vector.

The plasmid p0157 was isolated from *E. coli* O157:H7 EDL933W using standard methods known to the art. The plasmid was shotgun cloned into the Janus M13 vector.

Total genomic DNA from *E. coli* O157:H7 EDL933 was shotgun cloned into the Janus M13 vector.

DNA Sequence Determination and Analysis

Random shotgun cloning of total genomic DNA into the Janus M13 vector (Burland et al., *Nucleic Acids Res.* 21: 3385–3390 (1993)) provided template for automated sequencing using dye-terminator chemistry. A sufficient number of random clones was sequenced to provide 6x coverage of each element with a minimum quality of 2x coverage, including both strands, for all regions. The sequences were assembled using SeqManII (DNASTAR) and edited manually.

Open reading frames were located with GeneQuest (DNASTAR) using both *E. coli* and phage trained matrices and annotated based on protein sequence searches (DeCypherII Hardware/software System, TimeLogic, Inc.). All sequence alignments were performed using MegAlign or Align (DNASTAR) and levels of divergence were assessed with the Molecular Evolutionary Genetic Analysis (MEGA) software package (Kumar et al., MEGA: *Molecular evolutionary genetics analysis*. The Pennsylvania State University, University Park (1993)). The Codon Adaptation Index (CAI) was calculated by the method of Sharp and Li (*Nucleic Acids Res.* 15(3): 1281–1295 (1987)).

TABLE 1

| Sequence_ID | Length (bp) | Description |
| --- | --- | --- |
| OZID_1 | 6506 | putative outer membrane protein, usher and chaperone, possibly fimbrial |
| OZID_2 | 41 | small (41 bp) no features |
| OZID_3 | 635 | topoisomerase toxin-antitoxin system |
| OZID_4 | 1010 | unknown |
| OZID_5 | 35 | small (35 bp) no features |
| OZID_6 | 30 | small (30 bp) no features |
| OZID_7 | 9381 | putative fimbrial biosynthesis cluster homologous to K-12 but highly divergent |
| OZID_8 | 32 | small (32 bp), no features |
| OZID_9 | 124 | unknown, no ORFs |
| OZID_10 | 221 | yafE, putative enzyme |
| OZID_11 | 31960 | many unknowns, putative macrophage toxin, clpB paralog, and rhsG |
| OZID_12 | 3660 | rhs element |
| OZID_13 | 10523 | lambdoid prophage integrated downstream of tRNA-thrW |
| OZID_14 | 12886 | P4-like prophage integrated downstream of tRNA-thrW |
| OZID_15 | 6133 | unknowns including 3 orfs similar to cluster (orf2, orf3, opdE) implicated in regulation of a *Pseudomonas aeruginosa* porin for imipenem/basic amino acid uptake, begins within B0282-yagP, putative regulator |
| OZID_16 | 2450 | ISEc8 plus 8 bp duplicated target site |
| OZID_17 | 4716 | several oxidoreductases, unknowns and a transcriptional regulator |
| OZID_18 | 3695 | extends C-terminus of eaeH creating a much longer putative adhesin similar to intimin of the LEE of this organism and invasins of Yersinia, extends C-terminus of ykgA, putative regulator |
| OZID_19 | 589 | putative dehydrogenase (partial) |
| OZID_20 | 100 | putative dehydrogenase (partial) |
| OZID_21 | 4998 | unknowns including putative broken recombinase and possible invertible region |
| OZID_22 | 4643 | putative secreted protein similar to AIDA-I (diffuse adherence in DAEC 2787) and transport protein |
| OZID_23 | 94 | REP region |
| OZID_24 | 93 | no features |
| OZID_25 | 598 | unknowns |
| OZID_26 | 4588 | putative sugar (possibly ribose) transport system |
| OZID_27 | 565 | spanned by REP region |
| OZID_28 | 1834 | putative regulator and unknown |
| OZID_29 | 8114 | ferric iron uptake system similar to afuABC of Actinobacillus and two component regulatory system similar to uhpABC which is involved with hexose phosphate transport |
| OZID_30 | 1394 | putative structural protein created by merging 5' end of B0371-yaiT and B0374-yaiU |
| OZID_31 | 45 | small (45 bp) |
| OZID_32 | 1939 | creates alternate N-ter (much longer reading frame) for K-12 orf B0392, unknown |
| OZID_33 | 372 | unknown |
| OZID_34 | 1650 | unknown |

TABLE 1-continued

| Sequence_ID | Length (bp) | Description |
|---|---|---|
| OZID_35 | 687 | unknowns similar to unknowns found in Yersinia and Mycobacterium |
| OZID_36 | 1983 | unknown |
| OZID_37 | 39 | small (39 bp) no features |
| OZID_38 | 53 | small (53 bp), no annotated features |
| OZID_39 | 25165 | putative novel RTX-like exoprotein and transport system |
| OZID_40 | 2643 | unknowns, REP region |
| OZID_42 | 29 | REP region |
| OZID_43 | 11613 | novel Rhs element |
| OZID_44 | 491 | largely a tandem repeat of preceding 468 bp (one copy in K-12 and it is disrupted by IS186) |
| OZID_45 | 30 | small (30 bp) nd features |
| OZID_46 | 520 | IRU with 69 bp deletion in center |
| OZID_47 | 1403 | small unknowns |
| OZID_48 | 70 | small (70 bp), no annotated features |
| OZID_49 | 13965 | putative glutamate uptake and fermentation system plus several unknowns |
| OZID_50 | 49 | small (49 bp) no features |
| OZID_52 | 38577 | lambdoid prophage |
| OZID_53 | 2807 | unknowns |
| OZID_54 | 103 | internal segment of unknown, REP region |
| OZID_55 | 996 | 2 unknowns |
| OZID_56 | 3515 | unknowns and putative sulfatase |
| OZID_57 | 2561 | 2 unknowns |
| OZID_58 | 349 | unknown |
| OZID_59 | 87563 | 3' end of serW; integrase, urease, tellurite resistance, complement resistance, diacylglycerol kinase, colicin immunity, secreted proteins, outer membrane receptor, DNA repair, CP4-like prophage ORFs, unknowns; IS cluster, partials, ISEc8, IS629, IS1A |
| OZID_60 | 40 | 39 bp insertion in ftsK leading to 13 aa insertion in a glutamine and proline rich repetitive region |
| OZID_61 | 40 | small (40 bp), no annotated features |
| OZID_62 | 49795 | putative lambdoid phage beginning in 3' end of serT tRNA includes some genes similar to database entries: integrase, unknowns, division inhibition protein, lambdoid phage lysis genes, regulator. Partial IS elements, enterotoxin EAST1, IS629 with deletion |
| OZID_63 | 2512 | continued from the end of previous contig |
| OZID_64 | 61658 | 933W, fully described in Plunkett et al., J. Bacteriol. 181:1767–1778 (1999) |
| OZID_65 | 2499 | unknown |
| OZID_66 | 31728 | large cluster including many unknowns, a pilin-like structural subunit and chaperone, putative secreted protein, HecB-like protein and several genes encoding components of a fatty acid or polyketide biosynthesis system |
| OZID_67 | 988 | no annotated features |
| OZID_68 | 9827 | no annotated features |
| OZID_69 | 1411 | 2 genes similar to elements of the 933L, the cryptic P4- family prophage in the LEE |
| OZID_70 | 104 | REP region |
| OZID_71 | 26173 | lambdoid prophage with a broken integrase similar to e14 and P21, also sporadic matches to other E. coli phage, including 933W |
| OZID_72 | 3191 | 152 and IS285 partials, unknown orfs |
| OZID_73 | 15472 | lambdoid prophage with Salmonella-like integrase, sporadic matches to other coli phage, Streptomyces phi-C31 and Bacillus phi-105, REP region |
| OZID_74 | 46819 | lambdoid prophage with P21-like integrase and excisionase, and very lambda-like structural genes; IS629 with deletion |
| OZID_75 | 33 | small (33 bp), no annotated features |
| OZID_76 | 92 | no annotated features |
| OZID_77 | 1313 | IS629 is entire segment |
| OZID_78 | 6737 | TonB dependent outer membrane receptor, molybdenum and/or iron transport proteins, and several unknowns |
| OZID_79 | 75 | no annotated features |
| OZID_80 | 41 | no features |
| OZID_81 | 38276 | lambdoid prophage with P21-like integrase, sporadic matches to various E. coli and B. subtilis phage, lambda-like tail components, a partial tonB paralog, and many unknowns |
| OZID_82 | 354 | no annotated features |
| OZID_83 | 205 | unknown |
| OZID_84 | 1494 | unknowns |
| OZID_85 | 498 | extends N-terminus of K-12 hypothetical B1522 |
| OZID_86 | 124 | unknown |
| OZID_87 | 3281 | putative fimbrial genes including an usher, chaperone and structural subunit |
| OZID_88 | 1548 | 1 unknown and 2 orfs similar to bacteriophage PA-2 |
| OZID_89 | 653 | within a K-12 putative glycoprotein (B1471) |
| OZID_90 | 33 | rhs element |
| OZID_91 | 1206 | rhs element, partial IS1N |
| OZID_92 | 4447 | rhs element |
| OZID_93 | 1813 | unknowns |
| OZID_94 | 32 | small (32 bp) no features |
| OZID_95 | 4268 | unknowns most similar to a broken K-12 gene (ydbA = rtoA) in the replaced region, possibly hypervariable with a duplication, but lacking an 152–1530 hybrid; REP region |
| OZID_96 | 3404 | unknowns |
| OZID_97 | 101 | no features |
| OZID_98 | 34063 | lambdoid phage with many unknowns, mixed matches to E. coli phage including 933W, H-19B, N15, P21, and very lamda-like tail components, 15629 |
| OZID_99 | 494 | unknown |
| OZID_100 | 873 | two orfs similar to cl and cro of bacteriophage HK022 |
| OZID_101 | 1313 | 15629 is whole segment |
| OZID_102 | 883 | unknowns |
| OZID_103 | 665 | unknown |
| OZID_104 | 7886 | putative drug resistance efflux pump |
| OZID_105 | 3983 | chaperone protein, 15630 partial |
| OZID_106 | 6232 | putative phage components and unknown orfs |
| OZID_107 | 1711 | unknown orfs |
| OZID_108 | 44 | no annotated features; 44 bp |
| OZID_109 | 841 | unknown orf |
| OZID_110 | 1314 | 15629 |
| OZID_111 | 225 | 225 bp;no features |
| OZID_112 | 102 | 102 bp;no features |
| OZID_113 | 21119 | HP1/S2 integrase; phage regulator and replication proteins, partition genes, P2 tail fiber components, IS30 and IS629 partials |
| OZID_114 | 931 | part of flagellin |
| OZID_115 | 1958 | orf similar to of Y. enterocolitica |
| OZID_116 | 62 | small (62 bp) no features |
| OZID_117 | 38 | small (38 bp) no features |
| OZID_118 | 45175 | lambdoid phage components lom, tail fiber, regulators, and integrase. Contains ClpP peptidase, cell division regulator, unknown orfs, IS629, 4 REP regions |
| OZID_119 | 906 | part of K-12 largest ORF |
| OZID_120 | 2448 | ISEc8 |
| OZID_121 | 3275 | unknowns, IS629 |
| OZID_122 | 210 | unknowns |
| OZID_123 | 14187 | complete O157 O-antigen biosynthesis cluster |
| OZID_124 | 1376 | putative UDP-galactose 4-epimerase |
| OZID_125 | 88 | 88 bp; no annotated features |
| OZID_126 | 745 | bacteriophage N15 gp49; putative regulator |
| OZID_127 | 328 | 328 bp; no annotated features |

TABLE 1-continued

| Sequence_ID | Length (bp) | Description |
|---|---|---|
| OZID_128 | 2272 | unknowns |
| OZID_129 | 30 | small (30 bp) no features |
| OZID_130 | 958 | putative fimbrial component; hypervariable homolog of yehA |
| OZID_131 | 69 | no features |
| OZID_132 | 26 | small (26 bp) no features |
| OZID_133 | 30 | small (30 bp) no features |
| OZID_134 | 3823 | putative regulator of molybdate metabolism |
| OZID_135 | 1304 | putative regulator of molybdate metabolism |
| OZID_136 | 935 | unknowns |
| OZID_137 | 1313 | IS629 |
| OZID_138 | 25 | small (25 bp) no features |
| OZID_139 | 48907 | Lambdoid phage components lom, putative prophage components; phage contains Shiga toxin SLTkla and b subunits, Q regulator and putative superoxide dismutase; putative CTX putative proteases, ISEc8, unknowns, integrase, REP region |
| OZID_140 | 41 | 40 bp; no annotated features |
| OZID_141 | 377 | unknown |
| OZID_142 | 6185 | aromatic degradation cluster; LYS-R-type regulator, partial BoxC repeat |
| OZID_143 | 150 | 150 bp; no annotated features |
| OZID_144 | 1879 | putative antibiotic efflux protein |
| OZID_145 | 1713 | unknown |
| OZID_146 | 36 | small (36 bp) no features |
| OZID_147 | 207 | partial RSA repeat |
| OZID_148 | 182 | unknown, spanned by REP region |
| OZID_149 | 7198 | unknowns; begin hypervariable fimbrial subunits, chaperone and ushers |
| OZID_150 | 186 | part of unknown ORF |
| OZID_151 | 12804 | bacteriophage P22 gp7 and 14; unknowns; putative resolvase; sucrose permease, hydrolase and regulator, fructokinase. |
| OZID_152 | 1748 | ISEco1253 is entire segment |
| OZID_153 | 396 | unknowns |
| OZID_154 | 35 | small (35 bp) no features |
| OZID_155 | 48 | small (48 bp) no features |
| OZID_156 | 4859 | DMSO reductase subunits |
| OZID_157 | 42 | part of unknown ORF |
| OZID_158 | 132 | putative ATP synthase beta subunit |
| OZID_159 | 4190 | unknowns; putative chaperone |
| OZID_160 | 17136 | unknowns; lambdoid bacteriophage components Rz, R, antirepressor, Q, nin, lambdoid unknowns, IS30 and IS911 partials, integrase, REP region |
| OZID_161 | 2077 | putative regulator; unknown |
| OZID_162 | 40 | small (40 bp) no features |
| OZID_163 | 2936 | unknowns; putative decarboxylase, putative regulator |
| OZID_164 | 9179 | Beginning of series of unknowns similar to K-12 counterparts: hypervariable; 3 iap repeats |
| OZID_165 | 32 | small (32 bp) no features |
| OZID_166 | 3487 | unknowns |
| OZID_167 | 236 | unknown |
| OZID_168 | 16950 | large cluster encoding a putative type III secretion system, response regulator for 2 component system, InvF-like and putative secreted proteins, and a putative lipoprotein |
| OZID_169 | 78 | part of a putative lipoprotein |
| OZID_170 | 80 | no features |
| OZID_171 | 395 | part of a putative D-3 phosphoglycerate dehydrogenase |
| OZID_172 | 3267 | unknowns; putative ATP-binding components of ABC transport system; part of a putative kinase |
| OZID_173 | 935 | unknown |
| OZID_174 | 87 | 87 bp; REP region |
| OZID_175 | 23451 | putative P4-type integrase; putative enterotoxin, cytotoxin and PagC-like virulence factors; ISEc8 complex cluster; IS2, IS1N, ISEc8, IS630 partials; IS629; ISEc8, IS3 and IS911 partials |
| OZID_176 | 7304 | putative iron compound transport system, REP region |
| OZID_177 | 62 | 62 bp; no annotated features |
| OZID_178 | 375 | not annotated |
| OZID_179 | 100 | REP region |
| OZID_180 | 28 | small (28 bp) no features |
| OZID_181 | 2326 | PS subunits |
| OZID_182 | 1307 | unknowns; 15629; N-terminus of a putative fimbrial protein |
| OZID_183 | 54 | no features |
| OZID_184 | 53 | small (53 bp) no features |
| OZID_185 | 674 | not annotated |
| OZID_186 | 73 | no features |
| OZID_187 | 889 | unknowns |
| OZID_188 | 2906 | unknowns |
| OZID_189 | 3511 | unknowns; helicase (3 ORFs) |
| OZID_190 | 1819 | unknowns |
| OZID_191 | 1041 | unknowns |
| OZID_192 | 943 | unknowns |
| OZID_193 | 15393 | unknowns; putative enzymes of fatty acid biosynthesis (acyl carriers, synthases and reductase); unclassified putative enzymes |
| OZID_194 | 6563 | unknowns; putative PTS subunits; putative xylulose kinase, putative phosphocarrier; putative aldolase |
| OZID_195 | 25 | small (25 bp) no features |
| OZID_196 | 9057 | heme/hemoglobin uptake system homologous to the Shu system of Shigella dysenteriae |
| OZID_197 | 5903 | putative long polar fimbrial subunits, usher and chaperone |
| OZID_198 | 39 | small (39 bp) no features |
| OZID_199 | 4021 | putative regulator, putative permease, unknown |
| OZID_200 | 217 | C-termini of an unknown and a putative outer membrane protein |
| OZID_201 | 1368 | unknown |
| OZID_202 | 6091 | unknown; putative adhesin |
| OZID_203 | 5407 | putative LPS biosynthesis enzymes |
| OZID_204 | 39 | small (39 bp) no features |
| OZID_205 | 62 | small (62 bp) no features |
| OZID_206 | 140 | hypervariable |
| OZID_207 | 857 | unknown |
| OZID_208 | 43418 | LEE element; fully described in Perna et al., Infection and Immunity 66:3810-3817 (1998) |
| OZID_209 | 840 | unknowns |
| OZID_210 | 3357 | unknowns |
| OZID_211 | 508 | part of putative 6-phospho-beta-glucosidase |
| OZID_212 | 2625 | unknowns |
| OZID_213 | 27 | small (27 bp) no features |
| OZID_214 | 7425 | unknowns, REP region |
| OZID_215 | 6943 | putative lpf-like fimbrial subunits, usher and chaperones |
| OZID_216 | 1003 | unknowns, REP region overlaps left end |
| OZID_217 | 2692 | unknowns |
| OZID_218 | 48 | small (48 bp) no features |
| OZID_219 | 38 | small (38 bp) no features |
| OZID_220 | 34 | 34 bp; REP region |
| OZID_221 | 48 | 48 bp, no features |
| OZID_222 | 989 | unknown |
| OZID_223 | 46 | 46 bp; no features |
| OZID_224 | 2047 | unknowns |
| OZID_225 | 1751 | putative glycoporin |
| OZID_226 | 136 | REP region |
| OZID_227 | 1522 | unknowns |
| OZID_228 | 5519 | Rhs core; unknowns; partial ISN1 |
| OZID_229 | 2691 | putative hippuricase, putative citrate permease |
| OZID_230 | 131 | hypervariable |
| OZID_231 | 107 | REP region |
| OZID_232 | 6318 | putative PTS for sorbose |
| OZID_233 | 9306 | putative response regulator, putative aldolase, putative ABC transport system for ribose, putative histidine kinase |

TABLE 1-continued

| Sequence_ID | Length (bp) | Description |
|---|---|---|
| OZID_234 | 164 | no features |
| OZID_235 | 1748 | ISEco1253, no other features |
| OZID_236 | 26 | small (26 bp) no features |
| OZID_237 | 46 | no features |
| OZID_238 | 32 | small (32 bp) no features |
| OZID_239 | 29 | small (29 bp) no features |
| OZID_240 | 194 | unknown, spanned by REP region |
| OZID_241 | 90 | no features |
| OZID_242 | 10236 | IS629; unknowns; putative resolvase; partial IS1351 |
| OZID_243 | 1089 | no features |
| OZID_244 | 31880 | unknowns; putative helicases |
| OZID_245 | 5629 | putative invasin |
| OZID_246 | 2797 | unknowns |
| OZID_247 | 25 | small (25 bp) no features |
| OZID_248 | 2235 | conserved unknowns |
| OZID_249 | 7808 | putative restriction/modification system; conserved unknowns |
| OZID_250 | 822 | unknown |
| OZID_251 | 53 | small (53 bp) no features |
| OZID_252 | 287 | unknown |
| OZID_253 | 22306 | unplaced contig; putative phage components |
| OZID_254 | 12848 | unplaced contig; putative phage components and unknown orfs |
| OZID_255 | 5836 | unplaced contig; phage components |
| OZID_256 | 11481 | unplaced contig; phage components |
| OZID_257 | 4229 | unplaced contig, putative phage components and unknown orfs |

TABLE 2

| Sequence_ID | Orf_ID | Orf_Start | Orf_End | Description |
|---|---|---|---|---|
| OZID_1 | F0003 | 823 | 497 | |
| OZID_1 | F0004 | 3286 | 836 | putative usher protein |
| OZID_1 | F0005 | 3982 | 3299 | putative chaperone protein |
| OZID_1 | F0006 | 4526 | 4032 | putative fimbrial subunit-like structural protein |
| OZID_1 | F0007 | 6288 | 4867 | |
| OZID_100 | F0579 | 289 | 744 | |
| OZID_101 | F0578 | 55 | 381 | unknown in IS |
| OZID_101 | F0577 | 378 | 1268 | putative transposase |
| OZID_102 | F0575 | 346 | 873 | |
| OZID_104 | F0573 | 1208 | 45 | putative transmembrane protein |
| OZID_104 | F0572 | 2590 | 1217 | putative outer membrane channel protein |
| OZID_104 | F0571 | 5696 | 2613 | putative efflux pump |
| OZID_104 | F0570 | 6850 | 5696 | putative efflux pump |
| OZID_104 | F0569 | 7631 | 6966 | putative transcriptional repressor |
| OZID_105 | F0568 | 3882 | 3292 | putative chaperone |
| OZID_106 | F1382 | 1086 | 442 | |
| OZID_106 | F1381 | 1478 | 1083 | |
| OZID_106 | F1380 | 2162 | 1494 | |
| OZID_106 | F1379 | 2263 | 2084 | |
| OZID_106 | F1378 | 3029 | 2289 | |
| OZID_106 | F1377 | 4013 | 3036 | |
| OZID_106 | F1376 | 4446 | 4021 | |
| OZID_106 | F1375 | 4780 | 5214 | |
| OZID_106 | F1374 | 5181 | 5426 | |
| OZID_107 | F0664 | 153 | 1232 | |
| OZID_107 | F0665 | 1305 | 1556 | |
| OZID_11 | F0021 | 620 | 324 | |
| OZID_11 | F0022 | 1066 | 617 | |
| OZID_11 | F0023 | 1665 | 1069 | |
| OZID_11 | F0024 | 2007 | 1744 | |
| OZID_11 | F0025 | 2465 | 1986 | |
| OZID_11 | F0026 | 3930 | 2431 | |
| OZID_11 | F0027 | 7147 | 3851 | |
| OZID_11 | F0028 | 8216 | 7422 | |
| OZID_11 | F0029 | 8833 | 8213 | |
| OZID_11 | F0030 | 9581 | 8838 | |
| OZID_11 | F0031 | 12349 | 9578 | putative protease |
| OZID_11 | F0032 | 13119 | 12358 | |
| OZID_11 | F0034 | 14455 | 13124 | |
| OZID_11 | F0035 | 14955 | 14458 | |
| OZID_11 | F0036 | 16259 | 14979 | |
| OZID_11 | F0037 | 17372 | 16284 | |
| OZID_11 | F0038 | 19180 | 17330 | |
| OZID_11 | F0039 | 19597 | 19184 | |
| OZID_11 | F0040 | 21079 | 19688 | |
| OZID_11 | F0041 | 21354 | 21130 | |

TABLE 2-continued

| Sequence_ID | Orf_ID | Orf_Start | Orf_End | Description |
|---|---|---|---|---|
| OZID_11 | F0042 | 21889 | 21389 | |
| OZID_11 | F0043 | 22586 | 23104 | |
| OZID_11 | F0044 | 23314 | 25455 | |
| OZID_11 | F0045 | 25531 | 29745 | |
| OZID_11 | F0046 | 29748 | 30359 | |
| OZID_11 | F0047 | 30698 | 30997 | |
| OZID_110 | F0667 | 53 | 379 | orf; conserved hypothetical protein in IS |
| OZID_113 | F0670 | 381 | 106 | integrase (partial, C-terminus) |
| OZID_113 | F0671 | 1106 | 282 | integrase (partial, N-terminus) |
| OZID_113 | F0672 | 1459 | 1112 | |
| OZID_113 | F0673 | 2139 | 1489 | |
| OZID_113 | F0674 | 2559 | 2155 | putative phage-related repressor |
| OZID_113 | F0675 | 2635 | 2841 | |
| OZID_113 | F0676 | 2858 | 3061 | putative phage related regulator |
| OZID_113 | F0677 | 3083 | 3433 | peptidase |
| OZID_113 | F0678 | 3444 | 3722 | |
| OZID_113 | F0679 | 3734 | 3976 | |
| OZID_113 | F0680 | 4179 | 4595 | |
| OZID_113 | F0681 | 4619 | 4822 | |
| OZID_113 | F0682 | 4819 | 5085 | |
| OZID_113 | F0683 | 5082 | 5381 | |
| OZID_113 | F0684 | 5393 | 6010 | |
| OZID_113 | F0685 | 5704 | 5934 | |
| OZID_113 | F0686 | 6007 | 6372 | |
| OZID_113 | F0687 | 6379 | 9201 | putative phage replication protein |
| OZID_113 | F0688 | 9278 | 10237 | putative partition protein |
| OZID_113 | F0689 | 10242 | 10556 | putative partition protein |
| OZID_113 | F0690 | 11265 | 10576 | IS 629 transposase |
| OZID_113 | F0691 | 11591 | 11265 | orf; hypothetical protein conserved in several IS elements |
| OZID_113 | F0692 | 11762 | 12178 | phage morphogenesis protein |
| OZID_113 | F0694 | 12157 | 12477 | |
| OZID_113 | F0693 | 12173 | 11889 | |
| OZID_113 | F0695 | 12827 | 12222 | acetyltransferase |
| OZID_113 | F0696 | 13445 | 12951 | putative phage tail fiber protein |
| OZID_113 | F0697 | 14288 | 13452 | |
| OZID_113 | F0698 | 16291 | 14165 | putative tail fiber component |
| OZID_113 | F0699 | 16397 | 16242 | putative tail fiber protein component |
| OZID_113 | F0700 | 16771 | 16406 | putative tail fiber component |
| OZID_113 | F0701 | 17338 | 16826 | putative tail fiber component |
| OZID_113 | F0702 | 18522 | 17338 | putative tail fiber component |
| OZID_113 | F0703 | 18548 | 19003 | |
| OZID_113 | F0704 | 20144 | 18954 | IS30 transposase |
| OZID_113 | F0705 | 20636 | 20244 | |
| OZID_113 | F0706 | 20866 | 21117 | |
| OZID_118 | F0709 | 505 | 1158 | |
| OZID_118 | F0710 | 1483 | 2637 | |
| OZID_118 | F0711 | 4353 | 3034 | |
| OZID_118 | F0712 | 5011 | 4412 | membrane protein |
| OZID_118 | F0713 | 7505 | 5079 | phage tail protein |
| OZID_118 | F0714 | 8557 | 7382 | phage tail protein |
| OZID_118 | F0715 | 9475 | 8798 | phage tail protein |
| OZID_118 | F0717 | 10116 | 9373 | phage tail protein |
| OZID_118 | F1425 | 10304 | 10284 | |
| OZID_118 | F0718 | 10825 | 10127 | phage tail protein |
| OZID_118 | F0719 | 11154 | 10825 | phage tail protein |
| OZID_118 | F0720 | 11825 | 11151 | phage tail protein |
| OZID_118 | F0721 | 13806 | 11758 | phage tail protein |
| OZID_118 | F0722 | 14149 | 13841 | phage tail protein |
| OZID_118 | F0723 | 14472 | 14176 | phage tail protein |
| OZID_118 | F0724 | 15366 | 14614 | phage tail protein |
| OZID_118 | F0725 | 15772 | 15374 | phage tail protein |
| OZID_118 | F0726 | 16414 | 15785 | phage tail protein |
| OZID_118 | F0727 | 16692 | 16411 | |
| OZID_118 | F0728 | 17011 | 16685 | |
| OZID_118 | F0729 | 18139 | 17099 | |
| OZID_118 | F0730 | 18261 | 18587 | orf; hypothetical protein in IS |
| OZID_118 | F0804 | 18584 | 19474 | IS629 transposase |
| OZID_118 | F0732 | 19440 | 19631 | |
| OZID_118 | F0733 | 20583 | 19477 | putative peptidase |
| OZID_118 | F0734 | 21883 | 20381 | |
| OZID_118 | F0735 | 22044 | 21883 | |
| OZID_118 | F0736 | 24215 | 22092 | |
| OZID_118 | F0737 | 24688 | 24212 | |
| OZID_118 | F0738 | 25610 | 25143 | cell lysis protein |
| OZID_118 | F0739 | 26333 | 25764 | antirepressor |
| OZID_118 | F0740 | 27137 | 26604 | cell lysis protein |
| OZID_118 | F0741 | 27535 | 27188 | |

TABLE 2-continued

| Sequence_ID | Orf_ID | Orf_Start | Orf_End | Description |
|---|---|---|---|---|
| OZID_118 | F0742 | 27857 | 27537 | cell lysis protein |
| OZID_118 | F0743 | 29755 | 27902 | |
| OZID_118 | F0744 | 30586 | 30233 | |
| OZID_118 | F0745 | 31984 | 31295 | phage late gene regulator Q |
| OZID_118 | F0746 | 32340 | 31981 | putative endonuclease |
| OZID_118 | F0747 | 33402 | 32353 | |
| OZID_118 | F0748 | 33811 | 33404 | |
| OZID_118 | F0749 | 34398 | 34249 | |
| OZID_118 | F0750 | 35026 | 34463 | |
| OZID_118 | F0751 | 35446 | 35153 | |
| OZID_118 | F0752 | 35649 | 35461 | |
| OZID_118 | F0753 | 36002 | 35646 | |
| OZID_118 | F0754 | 36223 | 35999 | |
| OZID_118 | F0755 | 37009 | 36245 | |
| OZID_118 | F0756 | 37640 | 36978 | |
| OZID_118 | F0757 | 38475 | 37432 | |
| OZID_118 | F0758 | 38963 | 38538 | |
| OZID_118 | F0759 | 39187 | 38960 | putative regulator, cell division |
| OZID_118 | F0760 | 39282 | 39872 | |
| OZID_118 | F0761 | 40204 | 40356 | |
| OZID_118 | F0762 | 40837 | 41025 | putative inhibitor of cell division |
| OZID_118 | F0763 | 41022 | 41210 | |
| OZID_118 | F0764 | 41068 | 41166 | |
| OZID_118 | F0765 | 41306 | 43777 | |
| OZID_118 | F0766 | 43836 | 44039 | |
| OZID_118 | F0767 | 44039 | 45061 | integrase |
| OZID_12 | F0050 | 571 | 1749 | |
| OZID_12 | F0051 | 1951 | 2214 | |
| OZID_12 | F0052 | 2395 | 3567 | |
| OZID_120 | F0769 | 71 | 472 | |
| OZID_120 | F0770 | 469 | 816 | |
| OZID_121 | F0773 | 2019 | 2345 | unknown in IS |
| OZID_121 | F0774 | 2342 | 3232 | IS629 transposase |
| OZID_123 | F0777 | 845 | 180 | acetyl transferase; O-antigen biosynthesis |
| OZID_123 | F0778 | 3478 | 2108 | phosphomannomutase |
| OZID_123 | F0779 | 4930 | 3482 | mannose-1-P guanosyltransferase |
| OZID_123 | F0780 | 5421 | 4912 | GDP-mannose mannosylhydrolase |
| OZID_123 | F0781 | 6395 | 5424 | fucose synthetase |
| OZID_123 | F0782 | 7510 | 6392 | GDP-mannose dehydratase |
| OZID_123 | F0783 | 8744 | 7530 | glycosyl transferase |
| OZID_123 | F0784 | 9869 | 8769 | perosamine synthetase |
| OZID_123 | F0785 | 11257 | 9866 | O antigen flippase |
| OZID_123 | F0786 | 11990 | 11244 | glycosyl transferase |
| OZID_123 | F0787 | 12942 | 11959 | O antigen polymerase |
| OZID_123 | F0788 | 13922 | 13140 | glycosyl transferase |
| OZID_124 | F0789 | 1232 | 237 | putative UDP-galactose 4-epimerase |
| OZID_126 | F0790 | 73 | 411 | |
| OZID_126 | F0791 | 401 | 691 | putative regulator |
| OZID_128 | F0793 | 199 | 438 | |
| OZID_128 | F0794 | 1489 | 1836 | |
| OZID_128 | F0795 | 1846 | 2160 | |
| OZID_13 | F0054 | 1107 | 862 | early gene regulator |
| OZID_13 | F0055 | 1737 | 1348 | |
| OZID_13 | F0056 | 2458 | 1865 | repressor |
| OZID_13 | F0058 | 2679 | 2879 | antirepressor |
| OZID_13 | F0057 | 2783 | 2538 | |
| OZID_13 | F0059 | 2938 | 3291 | antiterminator |
| OZID_13 | F0060 | 3324 | 3932 | phage DNA replication |
| OZID_13 | F0061 | 3872 | 4246 | phage DNA replication |
| OZID_13 | F0062 | 4243 | 4554 | phage DNA replication |
| OZID_13 | F0063 | 4536 | 5264 | |
| OZID_13 | F0064 | 5276 | 5728 | phage tail protein |
| OZID_13 | F0065 | 6293 | 5700 | phage tail protein |
| OZID_13 | F0067 | 6781 | 7371 | DNA invertase |
| OZID_13 | F0066 | 6790 | 6293 | phage tail protein |
| OZID_13 | F0068 | 8202 | 7429 | |
| OZID_13 | F0070 | 9871 | 10089 | |
| OZID_13 | F0069 | 10176 | 9811 | |
| OZID_13 | F0071 | 10306 | 10458 | |
| OZID_134 | F0798 | 765 | 3656 | putative regulator |
| OZID_136 | F0800 | 167 | 370 | |
| OZID_136 | F0801 | 377 | 195 | |
| OZID_136 | F0802 | 560 | 408 | |
| OZID_139 | F0518 | 246 | 494 | |
| OZID_139 | F0517 | 1251 | 862 | |
| OZID_139 | F0822 | 3110 | 2511 | membrane protein |
| OZID_139 | F0825 | 6305 | 7339 | putative superoxide dismutase |

TABLE 2-continued

| Sequence_ID | Orf_ID | Orf_Start | Orf_End | Description |
|---|---|---|---|---|
| OZID_139 | F0823 | 6678 | 3181 | phage tail protein |
| OZID_139 | F0826 | 8210 | 7530 | phage tail protein |
| OZID_139 | F0827 | 9085 | 8108 | phage tail protein |
| OZID_139 | F0828 | 9560 | 8862 | phage tail protein |
| OZID_139 | F0829 | 9901 | 9560 | phage tail protein |
| OZID_139 | F0830 | 12974 | 9894 | phage tail protein |
| OZID_139 | F0831 | 13308 | 13027 | |
| OZID_139 | F0832 | 13706 | 13332 | |
| OZID_139 | F0833 | 14557 | 13712 | |
| OZID_139 | F0835 | 14831 | 14487 | |
| OZID_139 | F0836 | 15274 | 14828 | |
| OZID_139 | F0837 | 15957 | 15631 | |
| OZID_139 | F0838 | 18538 | 16037 | |
| OZID_139 | F0839 | 18705 | 18484 | |
| OZID_139 | F0842 | 22412 | 20751 | |
| OZID_139 | F0843 | 22972 | 22409 | phage DNA packaging protein |
| OZID_139 | F0844 | 23545 | 23156 | |
| OZID_139 | F0845 | 24148 | 24513 | |
| OZID_139 | F0846 | 24726 | 24259 | cell lysis protein |
| OZID_139 | F0847 | 25449 | 24880 | |
| OZID_139 | F0848 | 26253 | 25720 | cell lysis protein |
| OZID_139 | F0849 | 26970 | 26551 | |
| OZID_139 | F0850 | 29100 | 27154 | |
| OZID_139 | F0851 | 29227 | 29550 | |
| OZID_139 | F0852 | 29880 | 29611 | shiga-like toxin 1 subunit B |
| OZID_139 | F0853 | 30837 | 29890 | shiga-like toxin 1 subunit A |
| OZID_139 | F0854 | 31817 | 31344 | phage late gene regulator Q |
| OZID_139 | F0855 | 32567 | 31962 | |
| OZID_139 | F0856 | 33172 | 32729 | |
| OZID_139 | F0857 | 33833 | 33306 | |
| OZID_139 | F0858 | 34375 | 33830 | |
| OZID_139 | F0859 | 34658 | 34233 | |
| OZID_139 | F0860 | 35106 | 34828 | |
| OZID_139 | F0861 | 35467 | 35177 | |
| OZID_139 | F0862 | 36165 | 35464 | |
| OZID_139 | F0863 | 37100 | 36162 | phage replication protein |
| OZID_139 | F0864 | 37429 | 37133 | phage regulatory protein |
| OZID_139 | F0865 | 37801 | 37544 | phage repressor |
| OZID_139 | F0866 | 37871 | 38518 | phage repressor |
| OZID_139 | F0867 | 38930 | 39481 | |
| OZID_139 | F0868 | 39964 | 40266 | |
| OZID_139 | F0869 | 40864 | 40403 | |
| OZID_139 | F0870 | 41125 | 41493 | ssDNA-binding protein |
| OZID_139 | F0871 | 41494 | 41730 | phage regulatory protein |
| OZID_139 | F0872 | 41918 | 42214 | recombination protein |
| OZID_139 | F0873 | 42220 | 43005 | recombination protein |
| OZID_139 | F0874 | 43002 | 43679 | exonuclease |
| OZID_139 | F0875 | 44036 | 44317 | |
| OZID_139 | F0877 | 44634 | 45581 | |
| OZID_139 | F0878 | 45729 | 46016 | |
| OZID_139 | F0879 | 46093 | 46449 | |
| OZID_139 | F0880 | 46446 | 46808 | |
| OZID_139 | F0881 | 46896 | 47138 | |
| OZID_139 | F0882 | 47295 | 47549 | |
| OZID_139 | F0883 | 47583 | 48869 | putative integrase |
| OZID_14 | F0072 | 162 | 1007 | integrase |
| OZID_14 | F0073 | 1031 | 1342 | integrase |
| OZID_14 | F0074 | 1346 | 1762 | |
| OZID_14 | F0075 | 1735 | 2352 | |
| OZID_14 | F0076 | 2352 | 2810 | |
| OZID_14 | F0077 | 3045 | 3401 | |
| OZID_14 | F0078 | 3466 | 4056 | |
| OZID_14 | F0079 | 4056 | 4490 | |
| OZID_14 | F0080 | 5303 | 5031 | regulatory protein |
| OZID_14 | F0081 | 5860 | 5309 | |
| OZID_14 | F0082 | 6609 | 5857 | phage morphogenesis |
| OZID_14 | F0083 | 7543 | 7803 | DNA-binding protein; possible regulator |
| OZID_14 | F0084 | 7800 | 8357 | regulatory protein |
| OZID_14 | F0085 | 8354 | 8575 | |
| OZID_14 | F0086 | 8575 | 8898 | |
| OZID_14 | F0087 | 8912 | 11245 | replication protein (primase) |
| OZID_14 | F0088 | 12334 | 11378 | |
| OZID_141 | F0884 | 342 | 13 | |
| OZID_142 | F0885 | 1312 | 119 | putative hydroxylase |
| OZID_142 | F0886 | 1881 | 1327 | putative glutathione-S-transferase |
| OZID_142 | F0887 | 2681 | 1980 | putative isomerase-decarboxylase |
| OZID_142 | F0888 | 3724 | 2696 | putative 1,2-dioxygenase |

TABLE 2-continued

| Sequence_ID | Orf_ID | Orf_Start | Orf_End | Description |
|---|---|---|---|---|
| OZID_142 | F0889 | 4830 | 3736 | putative transporter |
| OZID_142 | F0890 | 5173 | 6129 | putative regulator |
| OZID_145 | F0895 | 455 | 1525 | |
| OZID_149 | F0901 | 1012 | 170 | |
| OZID_149 | F0902 | 1562 | 1014 | putative minor fimbrial subunit |
| OZID_149 | F0903 | 2002 | 1532 | putative minor fimbrial subunit |
| OZID_149 | F0904 | 2601 | 1999 | putative minor fimbrial subunit |
| OZID_149 | F0905 | 3268 | 2510 | putative fimbrial chaperone |
| OZID_149 | F0908 | 5942 | 3291 | putative fimbrial usher |
| OZID_149 | F0909 | 6575 | 6012 | putative major fimbrial subunit |
| OZID_15 | F0090 | 645 | 1382 | putative oxidoreductase |
| OZID_15 | F0091 | 1549 | 1827 | |
| OZID_15 | F0092 | 3432 | 2530 | putative LysR-like transcriptional regulator |
| OZID_15 | F0093 | 3579 | 4736 | |
| OZID_15 | F0095 | 4812 | 6005 | |
| OZID_150 | F1490 | 1541 | 408 | |
| OZID_151 | F0911 | 1312 | 176 | |
| OZID_151 | F0913 | 2002 | 1322 | |
| OZID_151 | F0914 | 2459 | 1989 | |
| OZID_151 | F0916 | 3008 | 3703 | |
| OZID_151 | F0915 | 3025 | 2456 | |
| OZID_151 | F0917 | 3880 | 3635 | |
| OZID_151 | F0918 | 5785 | 4373 | |
| OZID_151 | F0919 | 6148 | 5972 | |
| OZID_151 | F0920 | 6451 | 7077 | putative resolvase |
| OZID_151 | F0921 | 8922 | 7675 | sucrose permease |
| OZID_151 | F0922 | 9908 | 8994 | D-fructokinase |
| OZID_151 | F0923 | 10115 | 11557 | sucrose hydrolase |
| OZID_151 | F0924 | 12653 | 11565 | sucrose specific transcriptional regulator |
| OZID_152 | F0926 | 1251 | 43 | |
| OZID_156 | F0931 | 862 | 8 | |
| OZID_156 | F0932 | 1683 | 862 | putative DMSO reductase subunit C |
| OZID_156 | F0933 | 2305 | 1676 | putative DMSO reductase subunit B |
| OZID_156 | F0934 | 4683 | 2302 | putative DMSO reductase subunit A |
| OZID_159 | F0937 | 98 | 289 | |
| OZID_159 | F0938 | 268 | 516 | |
| OZID_159 | F0939 | 670 | 840 | |
| OZID_159 | F0940 | 1608 | 1018 | putative chaperone |
| OZID_159 | F0941 | 1791 | 2441 | |
| OZID_159 | F0942 | 2520 | 3578 | |
| OZID_16 | F0096 | 72 | 473 | |
| OZID_16 | F0097 | 470 | 817 | |
| OZID_16 | F0098 | 867 | 2405 | |
| OZID_160 | F1390 | 507 | 277 | |
| OZID_160 | F1391 | 905 | 558 | |
| OZID_160 | F1345 | 1227 | 907 | |
| OZID_160 | F1346 | 3125 | 1272 | |
| OZID_160 | F1347 | 3366 | 3695 | |
| OZID_160 | F0956 | 4544 | 3786 | |
| OZID_160 | F0957 | 5405 | 4782 | phage late gene regulator Q |
| OZID_160 | F0958 | 6067 | 5402 | |
| OZID_160 | F0959 | 6705 | 6064 | |
| OZID_160 | F0960 | 7297 | 6650 | |
| OZID_160 | F0961 | 7552 | 8307 | transposase for IS30 |
| OZID_160 | F0962 | 8367 | 8645 | |
| OZID_160 | F0963 | 9092 | 8721 | |
| OZID_160 | F0964 | 9942 | 9004 | |
| OZID_160 | F0965 | 10808 | 10338 | |
| OZID_160 | F0966 | 11247 | 10849 | |
| OZID_160 | F0967 | 11838 | 11248 | |
| OZID_160 | F0968 | 12878 | 11871 | |
| OZID_160 | F0969 | 13366 | 12875 | integrase |
| OZID_160 | F0970 | 15403 | 14465 | integrase |
| OZID_160 | F0971 | 15926 | 15720 | phage regulatory protein |
| OZID_160 | F0972 | 16877 | 16026 | |
| OZID_161 | F0973 | 1469 | 135 | putative regulator |
| OZID_161 | F0974 | 1557 | 1988 | |
| OZID_163 | F0976 | 277 | 41 | |
| OZID_163 | F0977 | 1715 | 288 | |
| OZID_163 | F0978 | 2308 | 1715 | putative decarboxylase |
| OZID_163 | F0979 | 2422 | 2862 | putative regulator |
| OZID_164 | F0981 | 572 | 279 | |
| OZID_164 | F0982 | 669 | 472 | |
| OZID_164 | F0983 | 1492 | 569 | |
| OZID_164 | F0984 | 2271 | 1489 | |
| OZID_164 | F0985 | 2867 | 2121 | |
| OZID_164 | F0986 | 3933 | 2878 | |

TABLE 2-continued

| Sequence_ID | Orf_ID | Orf_Start | Orf_End | Description |
| --- | --- | --- | --- | --- |
| OZID_164 | F0987 | 4481 | 3945 | |
| OZID_164 | F0988 | 6040 | 4478 | |
| OZID_164 | F0989 | 8837 | 6138 | |
| OZID_166 | F0991 | 268 | 567 | |
| OZID_166 | F0992 | 551 | 1255 | |
| OZID_166 | F0993 | 1489 | 2637 | |
| OZID_168 | F0998 | 932 | 198 | putative lipoprotein |
| OZID_168 | F0999 | 1261 | 929 | putative TypeIII secretion apparatus protein |
| OZID_168 | F1000 | 2979 | 3479 | putative response regulator of two component transport system |
| OZID_168 | F1001 | 4957 | 3836 | putative integral membrane protein-component of typeIII secretion apparatus |
| OZID_168 | F1002 | 5202 | 4966 | putative integral membrane protein-component of typeIII secretion apparatus |
| OZID_168 | F1003 | 5733 | 5281 | putative integral membrane protein-component of typeIII secretion apparatus |
| OZID_168 | F1004 | 6671 | 6006 | putative integral membrane protein-component of typeIII secretion apparatus |
| OZID_168 | F1005 | 7692 | 6661 | typeIII secretion apparatus protein |
| OZID_168 | F1006 | 8176 | 7607 | typeIII secretion apparatus protein |
| OZID_168 | F1007 | 8482 | 8249 | |
| OZID_168 | F1009 | 10227 | 8908 | typeIII secretion apparatus protein |
| OZID_168 | F1010 | 12292 | 10232 | typeIII secretion apparatus protein |
| OZID_168 | F1012 | 13454 | 12285 | secreted protein |
| OZID_168 | F1013 | 15138 | 13435 | putative InvG-like protein |
| OZID_168 | F1014 | 15884 | 15135 | putative InvF-like protein |
| OZID_168 | F1015 | 16409 | 16230 | |
| OZID_17 | F0100 | 2207 | 1287 | |
| OZID_17 | F0101 | 2301 | 3290 | putative LysR-like transcriptional regulator |
| OZID_17 | F0102 | 3934 | 3578 | |
| OZID_17 | F0104 | 4702 | 4127 | |
| OZID_172 | F1019 | 150 | 581 | |
| OZID_172 | F1020 | 604 | 1182 | |
| OZID_172 | F1021 | 1183 | 1890 | |
| OZID_172 | F1022 | 1872 | 2555 | putative ATP-binding protein of ABC transport system |
| OZID_172 | F1023 | 2516 | 3226 | putative ATP-binding protein of ABC transport system |
| OZID_173 | F1025 | 789 | 58 | |
| OZID_175 | F1027 | 197 | 1462 | putative P4 integrase |
| OZID_175 | F1028 | 2364 | 1579 | |
| OZID_175 | F1029 | 2396 | 3127 | |
| OZID_175 | F1030 | 3124 | 3471 | |
| OZID_175 | F1031 | 3491 | 4939 | |
| OZID_175 | F1032 | 5696 | 4740 | |
| OZID_175 | F1033 | 6341 | 5793 | putative PagC-like membrane protein |
| OZID_175 | F1034 | 7114 | 6914 | |
| OZID_175 | F1035 | 7643 | 8533 | putative transposase |
| OZID_175 | F1036 | 8886 | 9113 | |
| OZID_175 | F1037 | 9321 | 10970 | putative enterotoxin |
| OZID_175 | F1038 | 11578 | 12567 | |
| OZID_175 | F1039 | 12832 | 13290 | |
| OZID_175 | F1040 | 13668 | 14513 | |
| OZID_175 | F1041 | 15165 | 16466 | putative cytotoxin |
| OZID_175 | F1042 | 16751 | 17299 | putative cytotoxin |
| OZID_175 | F1043 | 18229 | 17339 | putative transposase |
| OZID_175 | F1044 | 18552 | 18226 | orf; hypothetical protein in IS |
| OZID_175 | F1045 | 18743 | 19090 | |
| OZID_175 | F1046 | 19140 | 20678 | |
| OZID_175 | F1050 | 20746 | 20904 | |
| OZID_175 | F1051 | 20901 | 21251 | |
| OZID_175 | F1052 | 21734 | 22864 | |
| OZID_175 | F1053 | 22914 | 23126 | putative transposase for IS3, partial |
| OZID_176 | F1054 | 931 | 44 | |
| OZID_176 | F1055 | 1935 | 928 | putative iron compound-binding protein of ABC transporter family |
| OZID_176 | F1056 | 2935 | 1886 | putative iron compound permease protein of ABC transporter family |
| OZID_176 | F1057 | 3915 | 2932 | putative iron compound permease protein of ABC transporter family |
| OZID_176 | F1058 | 4721 | 3912 | putative ATP-binding protein of ABC transporter family |
| OZID_176 | F1059 | 5095 | 7236 | putative iron compound receptor |
| OZID_178 | F1061 | 356 | 159 | |
| OZID_181 | F1064 | 393 | 1271 | putative phosphotransferase system enzyme subunit |
| OZID_181 | F1065 | 1289 | 1723 | putative phosphotransferase system enzyme subunit |
| OZID_182 | F1068 | 54 | 380 | orf; hypothetical protein in IS |
| OZID_182 | F1069 | 377 | 1267 | putative IS629 transposase |
| OZID_185 | F1072 | 194 | 661 | putative leader peptidase |
| OZID_187 | F1076 | 56 | 340 | |
| OZID_187 | F1077 | 331 | 816 | |
| OZID_188 | F1080 | 1529 | 537 | |

TABLE 2-continued

| Sequence_ID | Orf_ID | Orf_Start | Orf_End | Description |
| --- | --- | --- | --- | --- |
| OZID_189 | F1082 | 1340 | 45 | |
| OZID_189 | F1084 | 1471 | 1247 | ATP-dependent DNA helicase (together with next 3 orfs) |
| OZID_189 | F1085 | 2373 | 1399 | ATP-dependent DNA helicase (together with adjacent 3 orfs) |
| OZID_189 | F1086 | 2766 | 2377 | ATP-dependent DNA helicase (together with adjacent 3 orfs) |
| OZID_189 | F1087 | 3371 | 2763 | ATP-dependent DNA helicase (together with adjacent 3 orfs) |
| OZID_190 | F1088 | 210 | 1121 | |
| OZID_190 | F1089 | 1486 | 1070 | |
| OZID_191 | F1091 | 179 | 27 | |
| OZID_191 | F1092 | 922 | 176 | |
| OZID_192 | F1094 | 793 | 527 | |
| OZID_193 | F1096 | 383 | 772 | |
| OZID_193 | F1097 | 832 | 1899 | |
| OZID_193 | F1098 | 1940 | 2662 | |
| OZID_193 | F1099 | 2641 | 3480 | |
| OZID_193 | F1100 | 3455 | 3712 | putative acyl carrier protein |
| OZID_193 | F1101 | 3724 | 3975 | putative acyl carrier protein |
| OZID_193 | F1102 | 3980 | 4561 | |
| OZID_193 | F1103 | 4519 | 5919 | putative enzyme |
| OZID_193 | F1104 | 5876 | 6259 | putative enzyme |
| OZID_193 | F1105 | 6250 | 7926 | putative enzyme |
| OZID_193 | F1106 | 7930 | 8352 | |
| OZID_193 | F1107 | 8349 | 8954 | |
| OZID_193 | F1108 | 8923 | 11241 | |
| OZID_193 | F1109 | 11238 | 11822 | |
| OZID_193 | F1110 | 11824 | 12993 | putative 3-oxoacyl-[ACP] synthase |
| OZID_193 | F1111 | 12990 | 13454 | |
| OZID_193 | F1112 | 13454 | 14185 | putative beta-ketoacyl-ACP reductase |
| OZID_194 | F1115 | 191 | 946 | putative regulator |
| OZID_194 | F1116 | 971 | 1444 | putative phosphotransferase system enzyme subunit |
| OZID_194 | F1117 | 1441 | 1722 | putative phosphotransferase system enzyme subunit |
| OZID_194 | F1118 | 1769 | 3157 | putative phosphotransferase system enzyme subunit |
| OZID_194 | F1119 | 3150 | 4658 | putative xylulose kinase |
| OZID_194 | F1120 | 4648 | 4917 | putative phosphocarrier protein |
| OZID_194 | F1121 | 4949 | 5809 | putative aldolase |
| OZID_194 | F1122 | 6218 | 5859 | |
| OZID_194 | F1123 | 6490 | 6215 | |
| OZID_196 | F1124 | 1087 | 59 | putative heme/hemoglobin transport protein |
| OZID_196 | F1125 | 3118 | 1136 | outer membrane heme/hemoglobin receptor |
| OZID_196 | F1127 | 3801 | 4715 | putative periplasmic binding protein |
| OZID_196 | F1128 | 4735 | 6072 | putative oxygen independent coproporphyrinogen III oxidase |
| OZID_196 | F1129 | 6085 | 6579 | |
| OZID_196 | F1130 | 6579 | 7202 | |
| OZID_196 | F1131 | 7251 | 8243 | putative permease of iron compound ABC transport system |
| OZID_196 | F1132 | 8210 | 9010 | putative ATP-binding component of iron compound transport system |
| OZID_197 | F1133 | 601 | 71 | putative fimbrial subunit |
| OZID_197 | F1134 | 1661 | 606 | putative fimbrial protein |
| OZID_197 | F1135 | 3133 | 1676 | putative fimbrial usher |
| OZID_197 | F1136 | 4249 | 3146 | putative fimbrial usher |
| OZID_197 | F1138 | 4976 | 4278 | putative fimbrial chaperone |
| OZID_197 | F1139 | 5565 | 5029 | putative major fimbrial subunit |
| OZID_199 | F1141 | 937 | 2337 | putative permease |
| OZID_202 | F1146 | 868 | 1224 | |
| OZID_202 | F1147 | 1268 | 6034 | putative adhesin |
| OZID_203 | F1148 | 87 | 1295 | putative LPS biosynthesis enzyme |
| OZID_203 | F1149 | 2473 | 1331 | putative LPS biosynthesis enzyme |
| OZID_203 | F1150 | 3036 | 2482 | putative LPS biosynthesis enzyme |
| OZID_203 | F1151 | 4227 | 3520 | putative LPS biosynthesis enzyme |
| OZID_203 | F1152 | 5260 | 4253 | putative LPS biosynthesis enzyme |
| OZID_208 | L0003 | 181 | 1362 | putative P4 family integrase |
| OZID_208 | L0004 | 1461 | 1811 | unknown in IS |
| OZID_208 | L0005 | 1824 | 2006 | |
| OZID_208 | L0006 | 2024 | 2677 | unknown in IS |
| OZID_208 | L0007 | 2928 | 3302 | |
| OZID_208 | L0008 | 3299 | 3790 | |
| OZID_208 | L0009 | 3802 | 3999 | |
| OZID_208 | L0010 | 4084 | 4425 | |
| OZID_208 | L0012 | 4626 | 4811 | |
| OZID_208 | L0011 | 4652 | 4422 | |
| OZID_208 | L0013 | 5181 | 5582 | unknown in ISEc8 |
| OZID_208 | L0014 | 5579 | 5926 | unknown in ISEc8 |
| OZID_208 | L0015 | 5976 | 7514 | unknown in ISEc8 |
| OZID_208 | L0016 | 9125 | 8379 | putative secreted protein |
| OZID_208 | L0017 | 9488 | 9210 | |
| OZID_208 | L0018 | 9715 | 9494 | type III secretion apparatus protein |
| OZID_208 | L0019 | 10158 | 9751 | |
| OZID_208 | L0020 | 11103 | 10165 | secreted protein |

TABLE 2-continued

| Sequence_ID | Orf_ID | Orf_Start | Orf_End | Description |
| --- | --- | --- | --- | --- |
| OZID_208 | L0021 | 12248 | 11124 | secreted protein |
| OZID_208 | L0022 | 12839 | 12261 | secreted protein |
| OZID_208 | L0023 | 13953 | 12898 | putative type III secretion apparatus protein |
| OZID_208 | L0024 | 14096 | 15316 | type III secretion apparatus protein |
| OZID_208 | L0025 | 18384 | 15580 | intimin protein |
| OZID_208 | L0026 | 18914 | 18444 | putative chaperone |
| OZID_208 | L0027 | 20728 | 19052 | translocated intimin receptor |
| OZID_208 | L0028 | 21763 | 21152 | |
| OZID_208 | L0029 | 22029 | 22412 | |
| OZID_208 | L0030 | 23116 | 22610 | |
| OZID_208 | L0031 | 24064 | 23147 | putative type III secretion apparatus protein |
| OZID_208 | L0032 | 24302 | 24027 | |
| OZID_208 | L0033 | 24813 | 24436 | |
| OZID_208 | L0034 | 26156 | 24816 | type III secretion apparatus protein |
| OZID_208 | L0035 | 28167 | 26140 | type III secretion apparatus protein |
| OZID_208 | L0036 | 28517 | 28164 | |
| OZID_208 | L0037 | 28702 | 29001 | putative type III secretion apparatus protein |
| OZID_208 | L0038 | 29034 | 29462 | |
| OZID_208 | L0039 | 29465 | 30037 | type III secretion apparatus protein |
| OZID_208 | L0040 | 30043 | 30498 | |
| OZID_208 | L0041 | 30498 | 32036 | type III secretion apparatus protein |
| OZID_208 | L0042 | 32050 | 32505 | chaperone of espD |
| OZID_208 | L0043 | 33302 | 32889 | |
| OZID_208 | L0044 | 33728 | 33357 | |
| OZID_208 | L0045 | 33924 | 34382 | |
| OZID_208 | L0046 | 35416 | 34379 | type III secretion apparatus protein |
| OZID_208 | L0047 | 36185 | 35409 | type III secretion apparatus protein |
| OZID_208 | L0048 | 36454 | 36185 | type III secretion apparatus protein |
| OZID_208 | L0049 | 37107 | 36454 | type III secretion apparatus protein |
| OZID_208 | L0050 | 37807 | 37112 | |
| OZID_208 | L0051 | 38351 | 37752 | |
| OZID_208 | L0052 | 38671 | 38348 | |
| OZID_208 | L0053 | 38893 | 38675 | |
| OZID_208 | L0054 | 39297 | 38908 | |
| OZID_208 | L0055 | 40542 | 41738 | |
| OZID_208 | L0056 | 41866 | 42684 | |
| OZID_209 | F1212 | 139 | 492 | |
| OZID_209 | F1213 | 476 | 799 | |
| OZID_21 | F0108 | 322 | 74 | |
| OZID_21 | F0109 | 1349 | 240 | |
| OZID_21 | F0110 | 2137 | 1376 | |
| OZID_21 | F0112 | 2875 | 2291 | |
| OZID_21 | F0114 | 3122 | 2967 | |
| OZID_21 | F0116 | 3573 | 3415 | |
| OZID_21 | F0117 | 3977 | 3594 | |
| OZID_21 | F0118 | 4400 | 4242 | |
| OZID_210 | F1215 | 1203 | 100 | |
| OZID_210 | F1216 | 1596 | 1219 | |
| OZID_210 | F1217 | 2293 | 1811 | |
| OZID_210 | F1218 | 3106 | 2441 | |
| OZID_212 | F1222 | 377 | 147 | |
| OZID_212 | F1223 | 2331 | 328 | |
| OZID_214 | F1224 | 2545 | 137 | |
| OZID_214 | F1227 | 6763 | 4502 | |
| OZID_214 | F1229 | 7083 | 7268 | |
| OZID_214 | F1228 | 7174 | 6968 | |
| OZID_215 | F1231 | 1188 | 106 | putative fimbrial protein |
| OZID_215 | F1232 | 2286 | 1216 | putative fimbrial protein |
| OZID_215 | F1233 | 4832 | 2298 | putative fimbrial usher |
| OZID_215 | F1234 | 5015 | 4854 | putative fimbrial chaperone |
| OZID_215 | F1236 | 5539 | 5156 | putative fimbrial chaperone |
| OZID_215 | F1237 | 6245 | 5643 | putative major fimbrial subunit |
| OZID_216 | F1239 | 920 | 18 | orf; conserved hypothetical protein |
| OZID_217 | F1240 | 532 | 41 | |
| OZID_217 | F1241 | 1377 | 529 | |
| OZID_217 | F1242 | 2121 | 1735 | |
| OZID_217 | F1243 | 2326 | 2637 | |
| OZID_22 | F0120 | 468 | 4517 | putative beta-barrel outer membrane protein |
| OZID_222 | F1245 | 918 | 43 | |
| OZID_224 | F1249 | 835 | 1749 | |
| OZID_224 | F1250 | 1857 | 1675 | |
| OZID_225 | F1252 | 317 | 1711 | putative glycoporin |
| OZID_227 | F1255 | 753 | 37 | |
| OZID_227 | F1256 | 1472 | 786 | |
| OZID_228 | F1257 | 105 | 4289 | Rhs core protein |
| OZID_228 | F1258 | 4580 | 4858 | |
| OZID_228 | F1259 | 4897 | 4583 | orf; hypothetical protein in IS |

TABLE 2-continued

| Sequence_ID | Orf_ID | Orf_Start | Orf_End | Description |
|---|---|---|---|---|
| OZID_228 | F1260 | 5076 | 4891 | orf; hypothetical protein in IS |
| OZID_228 | F1261 | 5375 | 5103 | putative transposase |
| OZID_229 | F1262 | 200 | 1366 | putative hippuricase |
| OZID_232 | F1266 | 1533 | 292 | putative L-sorbose-1-P-reductase |
| OZID_232 | F1267 | 2397 | 1573 | putative sorbose PTS component |
| OZID_232 | F1268 | 3205 | 2408 | putative sorbose PTS component |
| OZID_232 | F1269 | 3765 | 3271 | putative sorbose PTS component |
| OZID_232 | F1270 | 4172 | 3765 | putative sorbose PTS component |
| OZID_232 | F1271 | 4988 | 4182 | putative D-glucitol-6-P-dehydrogenase |
| OZID_232 | F1272 | 6050 | 5058 | putative transcriptional regulator of sorbose uptake and utilization genes |
| OZID_233 | F1274 | 51 | 776 | putative response regulator |
| OZID_233 | F1275 | 1774 | 773 | |
| OZID_233 | F1276 | 2631 | 1771 | putative aldolase |
| OZID_233 | F1277 | 3329 | 2646 | |
| OZID_233 | F1278 | 4325 | 3384 | putative ribose binding protein of ABC transport system |
| OZID_233 | F1279 | 5318 | 4344 | putative permease of ribose ABC transport system |
| OZID_233 | F1281 | 6772 | 9045 | putative histidine kinase |
| OZID_233 | F1280 | 6868 | 5315 | putative ATP-binding protein of ribose ABC transport system |
| OZID_233 | F1282 | 9042 | 9218 | |
| OZID_235 | F1285 | 487 | 56 | putative transposase |
| OZID_235 | F1286 | 495 | 1703 | |
| OZID_242 | F1291 | 89 | 2038 | putative transposase or integrase |
| OZID_242 | F1487 | 2238 | 2564 | |
| OZID_242 | F1293 | 2561 | 3451 | IS629 transposase |
| OZID_242 | F1294 | 4011 | 3634 | |
| OZID_242 | F1295 | 4399 | 4133 | |
| OZID_242 | F1296 | 5936 | 5469 | |
| OZID_242 | F1297 | 6123 | 6698 | putative resolvase |
| OZID_242 | F1298 | 8213 | 6897 | |
| OZID_242 | F1299 | 9138 | 8365 | |
| OZID_242 | F1300 | 9255 | 9719 | |
| OZID_243 | F1302 | 105 | 272 | putative transposase |
| OZID_244 | F1304 | 1663 | 560 | |
| OZID_244 | F1305 | 2374 | 1667 | |
| OZID_244 | F1307 | 4090 | 2381 | |
| OZID_244 | F1308 | 4251 | 7604 | |
| OZID_244 | F1310 | 7595 | 13918 | |
| OZID_244 | F1311 | 14142 | 17000 | putative ATP-dependent helicase |
| OZID_244 | F1312 | 17003 | 21937 | |
| OZID_244 | F1313 | 21937 | 28278 | putative helicase |
| OZID_244 | F1314 | 28275 | 30389 | putative helicase |
| OZID_244 | F1315 | 31336 | 31154 | |
| OZID_244 | F1316 | 31587 | 31342 | |
| OZID_244 | F1317 | 31829 | 31518 | |
| OZID_245 | F1318 | 5257 | 155 | putative invasin |
| OZID_246 | F1320 | 2459 | 264 | |
| OZID_248 | F1322 | 92 | 973 | orf; conserved hypothetical protein |
| OZID_248 | F1323 | 1021 | 2184 | orf; conserved hypothetical protein |
| OZID_249 | F1325 | 1843 | 89 | putative restriction modification enzyme S subunit |
| OZID_249 | F1326 | 3348 | 1843 | putative restriction modification enzyme M subunit (methylase) |
| OZID_249 | F1327 | 5811 | 3379 | putative restriction modification enzyme R subunit (endonucleas |
| OZID_249 | F1328 | 6089 | 6373 | orf; conserved hypothetical protein |
| OZID_249 | F1329 | 6643 | 7740 | orf; conserved hypothetical protein |
| OZID_250 | F1330 | 651 | 109 | |
| OZID_253 | F1468 | 1291 | 692 | membrane protein |
| OZID_253 | F1467 | 4126 | 1358 | phage tail protein |
| OZID_253 | F1466 | 4755 | 4060 | phage tail protein |
| OZID_253 | F1465 | 5487 | 4816 | phage tail protein |
| OZID_253 | F1464 | 6128 | 5385 | phage tail protein |
| OZID_253 | F1463 | 6832 | 6134 | phage tail protein |
| OZID_253 | F1462 | 7161 | 6832 | phage tail protein |
| OZID_253 | F1461 | 9707 | 7158 | phage tail protein |
| OZID_253 | F1460 | 10134 | 9700 | phage tail protein |
| OZID_253 | F1459 | 10538 | 10116 | phage tail protein |
| OZID_253 | F1458 | 11324 | 10554 | phage tail protein |
| OZID_253 | F1457 | 11484 | 11302 | phage tail protein |
| OZID_253 | F1456 | 11675 | 11433 | phage tail protein |
| OZID_253 | F1454 | 12269 | 11691 | phage tail protein |
| OZID_253 | F1453 | 12634 | 12281 | phage morphogenesis protein |
| OZID_253 | F1450 | 14505 | 14167 | phage morphogenesis protein |
| OZID_253 | F1449 | 15057 | 14509 | phage capsid protein |
| OZID_253 | F1448 | 15791 | 14901 | phage capsid protein |
| OZID_253 | F1447 | 17412 | 15811 | phage capsid protein |
| OZID_253 | F1446 | 17615 | 17409 | phage morphogenesis protein |
| OZID_253 | F1444 | 19537 | 17612 | phage DNA packaging protein |
| OZID_253 | F1443 | 20057 | 19512 | phage DNA packaging protein |

TABLE 2-continued

| Sequence_ID | Orf_ID | Orf_Start | Orf_End | Description |
|---|---|---|---|---|
| OZID_253 | F1441 | 21837 | 21529 | cell lysis protein |
| OZID_254 | F1362 | 2117 | 1836 | |
| OZID_254 | F1361 | 2515 | 2141 | |
| OZID_254 | F1360 | 3309 | 2521 | |
| OZID_254 | F1359 | 3650 | 3306 | |
| OZID_254 | F1358 | 4093 | 3647 | |
| OZID_254 | F1357 | 4440 | 4090 | |
| OZID_254 | F1356 | 4776 | 4450 | |
| OZID_254 | F1355 | 5834 | 4773 | |
| OZID_254 | F1354 | 7195 | 5831 | |
| OZID_254 | F1351 | 11059 | 9461 | |
| OZID_254 | F0948 | 12283 | 11918 | |
| OZID_255 | F1366 | 2147 | 1467 | |
| OZID_255 | F1365 | 2959 | 2045 | |
| OZID_255 | F1363 | 3838 | 3497 | |
| OZID_256 | F1421 | 718 | 1593 | putative lambdoid phage tail fiber component |
| OZID_256 | F1422 | 1590 | 1886 | putative lambdoid phage tail fiber component |
| OZID_256 | F1423 | 1981 | 2346 | putative lambdoid phage tail fiber component, partial |
| OZID_256 | F1424 | 2356 | 2619 | putative lambdoid phage tail fiber component, partial |
| OZID_256 | F1427 | 3271 | 3780 | putative lambdoid phage tail fiber component, partial |
| OZID_256 | F1428 | 3659 | 3949 | putative lambdoid phage tail fiber component, partial |
| OZID_256 | F1429 | 4190 | 5365 | putative lambdoid phage tail fiber component, partial |
| OZID_256 | F1430 | 5242 | 5991 | putative lambdoid phage tail fiber component, partial |
| OZID_256 | F1431 | 5840 | 7450 | putative lambdoid phage tail fiber component, partial |
| OZID_256 | F1432 | 7453 | 7668 | putative lambdoid phage tail fiber component, partial |
| OZID_256 | F1433 | 7736 | 8335 | membrane protein |
| OZID_257 | F1437 | 1353 | 1057 | |
| OZID_26 | F0125 | 229 | 1215 | putative periplasmic binding protein, probable substrate ribose |
| OZID_26 | F0126 | 1264 | 1524 | putative ATP-binding component of transport system |
| OZID_26 | F0127 | 1570 | 2748 | putative ATP-binding component of transport system, probably ribose specific |
| OZID_26 | F0128 | 2741 | 3712 | putative permease component of transport system, probably ribose specific |
| OZID_28 | F0131 | 1728 | 940 | |
| OZID_29 | F0132 | 1116 | 58 | putative ATP-binding component of transport system for ferric iron |
| OZID_29 | F0133 | 3194 | 1116 | putative permease component of transport system for ferric iron |
| OZID_29 | F0134 | 4294 | 3263 | periplasmic ferric iron-binding protein |
| OZID_29 | F0135 | 5607 | 4291 | putative permease; hexosephosphate transport |
| OZID_29 | F0136 | 7221 | 5680 | putative sensor kinase; hexosephosphate transport |
| OZID_29 | F0137 | 7850 | 7221 | putative response regulator; hexosephosphate transport |
| OZID_3 | F0009 | 77 | 310 | putative antitoxin of gyrase inhibiting toxin-antitoxin system |
| OZID_3 | F0008 | 171 | 1 | |
| OZID_3 | F0010 | 313 | 627 | putative toxin of gyrase inhibiting toxin-antitoxin system |
| OZID_34 | F0141 | 70 | 237 | |
| OZID_34 | F0142 | 188 | 1633 | |
| OZID_35 | F0143 | 150 | 392 | |
| OZID_35 | F0144 | 352 | 666 | |
| OZID_36 | F0145 | 1753 | 182 | |
| OZID_39 | F0146 | 310 | 1665 | putative outer membrane export protein for RTX-like exoprotein |
| OZID_39 | F0147 | 1768 | 6153 | |
| OZID_39 | F0148 | 6361 | 21927 | |
| OZID_39 | F0149 | 21931 | 24093 | putative cytoplasmic membrane export protein for RTX-like exoprotein |
| OZID_4 | F0011 | 207 | 776 | |
| OZID_40 | F0151 | 207 | 4 | |
| OZID_40 | F0152 | 626 | 204 | |
| OZID_40 | F0153 | 1727 | 711 | |
| OZID_40 | F0154 | 2094 | 2456 | |
| OZID_43 | F0156 | 1260 | 124 | |
| OZID_43 | F0157 | 3057 | 1723 | |
| OZID_43 | F0158 | 8588 | 3651 | |
| OZID_43 | F0159 | 9069 | 8608 | |
| OZID_43 | F0160 | 10998 | 9097 | |
| OZ(D_44 | F0161 | 230 | 481 | |
| OZID_47 | F0162 | 232 | 432 | |
| OZID_47 | F0163 | 544 | 374 | |
| OZID_47 | F0164 | 917 | 702 | |
| OZID_47 | F0165 | 1136 | 1288 | |
| OZID_49 | F0167 | 564 | 1469 | putative LysR-like transcriptional regulator |
| OZID_49 | F0168 | 2105 | 1503 | putative corrinoid:ATP adenosyltransferase |
| OZID_49 | F0169 | 3767 | 2115 | putative fumarate hydratase |
| OZID_49 | F0170 | 4450 | 3875 | |
| OZID_49 | F0171 | 5175 | 4393 | |
| OZID_49 | F0172 | 5632 | 5315 | |
| OZID_49 | F0173 | 6999 | 5629 | |
| OZID_49 | F0174 | 8244 | 7003 | putative methylaspartate ammonia-lyase |
| OZID_49 | F0175 | 11096 | 9708 | putative glutamate mutase |

TABLE 2-continued

| Sequence_ID | Orf_ID | Orf_Start | Orf_End | Description |
|---|---|---|---|---|
| OZID_49 | F0176 | 11608 | 11096 | putative methylaspartate mutase |
| OZID_49 | F0177 | 11899 | 11732 | |
| OZID_49 | F0178 | 12515 | 12093 | |
| OZID_49 | F0179 | 13541 | 12597 | |
| OZID_52 | F0180 | 855 | 85 | integrase |
| OZID_52 | F0181 | 1825 | 2400 | |
| OZID_52 | F0183 | 3159 | 3344 | |
| OZID_52 | F0182 | 3212 | 2931 | |
| OZID_52 | F0184 | 4246 | 3566 | exonuclease |
| OZID_52 | F0185 | 4803 | 4243 | |
| OZID_52 | F0186 | 5283 | 5906 | |
| OZID_52 | F0187 | 6134 | 6565 | |
| OZID_52 | F0188 | 7736 | 6777 | |
| OZID_52 | F0189 | 8127 | 8900 | phage late gene regulator Q |
| OZID_52 | F0190 | 9069 | 9827 | |
| OZID_52 | F0191 | 10648 | 10908 | cell lysis protein |
| OZID_52 | F0192 | 10908 | 11405 | cell lysis protein |
| OZID_52 | F0193 | 11402 | 11869 | cell lysis protein |
| OZID_52 | F0194 | 11866 | 12009 | |
| OZID_52 | F0195 | 12305 | 12694 | |
| OZID_52 | F0196 | 12684 | 13175 | |
| OZID_52 | F0197 | 13175 | 15277 | DNA packaging protein |
| OZID_52 | F0198 | 15274 | 15486 | |
| OZID_52 | F0199 | 15414 | 16019 | |
| OZID_52 | F0200 | 16016 | 16537 | |
| OZID_52 | F0201 | 16789 | 18966 | peptidase |
| OZID_52 | F0202 | 19053 | 19376 | |
| OZID_52 | F0203 | 19369 | 19644 | |
| OZID_52 | F0204 | 19656 | 20234 | phage morphogenesis protein |
| OZID_52 | F0205 | 20231 | 20632 | phage morphogenesis protein |
| OZID_52 | F0206 | 20568 | 21386 | phage morphogenesis protein |
| OZID_52 | F0207 | 21435 | 21833 | phage morphogenesis protein |
| OZID_52 | F0208 | 21842 | 22171 | phage morphogenesis protein |
| OZID_52 | F0209 | 22134 | 25208 | phage morphogenesis protein |
| OZID_52 | F0210 | 25208 | 25537 | phage morphogenesis protein |
| OZID_52 | F0211 | 25547 | 26245 | phage morphogenesis protein |
| OZID_52 | F0212 | 26251 | 26994 | phage morphogenesis protein |
| OZID_52 | F0213 | 26892 | 27539 | phage morphogenesis protein |
| OZID_52 | F0214 | 27600 | 28307 | phage morphogenesis protein |
| OZID_52 | F0215 | 28222 | 31017 | phage morphogenesis protein |
| OZID_52 | F0216 | 31088 | 31687 | |
| OZID_52 | F0217 | 31747 | 33063 | phage tail protein |
| OZID_52 | F0218 | 33511 | 34491 | |
| OZID_52 | F0220 | 34525 | 35544 | |
| OZID_52 | F0221 | 36646 | 37254 | |
| OZID_52 | F0222 | 37485 | 38183 | |
| OZID_53 | F0223 | 607 | 2619 | |
| OZID_53 | F0225 | 2546 | 2749 | |
| OZID_55 | F0231 | 400 | 71 | |
| OZID_55 | F0232 | 776 | 390 | |
| OZID_56 | F0233 | 287 | 1630 | |
| OZID_56 | F0234 | 1652 | 1972 | |
| OZID_56 | F0235 | 1984 | 3465 | putative sulfatase |
| OZID_57 | F0236 | 606 | 1847 | |
| OZID_57 | F0237 | 1957 | 2412 | |
| OZID_59 | F0239 | 161 | 1363 | putative P4-family integrase |
| OZID_59 | F0240 | 3367 | 1550 | |
| OZID_59 | F1480 | 3564 | 3659 | transposase |
| OZID_59 | F1481 | 3660 | 3836 | transposase |
| OZID_59 | F0242 | 3855 | 4025 | |
| OZID_59 | F0243 | 3863 | 4300 | transposase |
| OZID_59 | F0241 | 4159 | 3821 | |
| OZID_59 | F0244 | 4467 | 4775 | putative prophage regulatory protein |
| OZID_59 | F0245 | 5400 | 6803 | |
| OZID_59 | F0246 | 7624 | 8187 | |
| OZID_59 | F0247 | 8318 | 10702 | |
| OZID_59 | F0248 | 12997 | 11459 | unknown in ISEc8 |
| OZID_59 | F0249 | 13394 | 13047 | unknown in ISEc8 |
| OZID_59 | F0250 | 13792 | 13391 | unknown in ISEc8 |
| OZID_59 | F0251 | 14158 | 13847 | putative transposase |
| OZID_59 | F0252 | 14298 | 15116 | unknown in IS600 |
| OZID_59 | F0253 | 15229 | 15768 | putative complement resistance protein |
| OZID_59 | F0254 | 17067 | 17426 | putative diacylglycerol kinase |
| OZID_59 | F0255 | 19138 | 17519 | |
| OZID_59 | F0256 | 20019 | 20717 | putative urease accessory protein D |
| OZID_59 | F0257 | 20808 | 21110 | putative urease structural subunit A (gamma) |
| OZID_59 | F0258 | 21119 | 21439 | putative urease structural subunit B (beta) |

TABLE 2-continued

| Sequence_ID | Orf_ID | Orf_Start | Orf_End | Description |
|---|---|---|---|---|
| OZID_59 | F0259 | 21414 | 23135 | putative urease structural subunit C (alpha) |
| OZID_59 | F0260 | 23145 | 23609 | putative urease accessory protein E |
| OZID_59 | F0261 | 23610 | 24284 | putative urease accessory protein |
| OZID_59 | F0262 | 24296 | 24913 | putative urease accessory protein |
| OZID_59 | F0263 | 24900 | 24514 | |
| OZID_59 | F0264 | 25510 | 25169 | unknown in IS |
| OZID_59 | F0265 | 26125 | 26388 | putative ribosomal protein |
| OZID_59 | F0266 | 27139 | 26762 | |
| OZID_59 | F0267 | 27657 | 27262 | putative colicin immunity protein |
| OZID_59 | F0268 | 28440 | 27703 | |
| OZID_59 | F0269 | 29449 | 30210 | |
| OZID_59 | F0271 | 30391 | 30660 | |
| OZID_59 | F0270 | 30524 | 29907 | unknown in ISEc8 |
| OZID_59 | F0272 | 30712 | 31137 | unknown in ISEc8 |
| OZID_59 | F0273 | 31134 | 31484 | unknown in ISEc8 |
| OZID_59 | F0274 | 31515 | 33128 | unknown in ISEc8 |
| OZID_59 | F0276 | 33378 | 33674 | |
| OZID_59 | F0277 | 33747 | 34490 | |
| OZID_59 | F0275 | 33989 | 33132 | unknown in ISEc8 |
| OZID_59 | F0278 | 34412 | 34071 | unknown in ISEc8 |
| OZID_59 | F0279 | 34728 | 34399 | unknown in ISEc8 |
| OZID_59 | F0280 | 35456 | 34989 | unknown associated with putative tellurite resistance |
| OZID_59 | F0281 | 36682 | 35474 | |
| OZID_59 | F0282 | 37649 | 36693 | |
| OZID_59 | F0283 | 38728 | 37649 | |
| OZID_59 | F0284 | 39503 | 38730 | |
| OZID_59 | F0285 | 40638 | 39496 | |
| OZID_59 | F0286 | 41706 | 40648 | |
| OZID_59 | F0287 | 42029 | 42610 | putative phage inhibition, colicin resistance and tellurite resistance protein |
| OZID_59 | F0288 | 42610 | 43767 | putative phage inhibition, colicin resistance and tellurite resistance protein |
| OZID_59 | F0289 | 43790 | 44245 | putative phage inhibition, colicin resistance and tellurite resistance protein |
| OZID_59 | F0290 | 44268 | 45308 | putative phage inhibition, colicin resistance and tellurite resistance protein |
| OZID_59 | F0292 | 45357 | 45935 | putative phage inhibition, colicin resistance and tellurite resistance protein |
| OZID_59 | F0293 | 46004 | 46579 | putative phage inhibition, colicin resistance and tellurite resistance protein |
| OZID_59 | F0294 | 49991 | 47901 | putative receptor |
| OZID_59 | F0295 | 51424 | 51663 | |
| OZID_59 | F0296 | 52296 | 52631 | |
| OZID_59 | F0297 | 52742 | 52933 | |
| OZID_59 | F0299 | 53542 | 53910 | |
| OZID_59 | F0298 | 53606 | 53412 | |
| OZID_59 | F0300 | 53837 | 53658 | |
| OZID_59 | F0301 | 53926 | 54198 | |
| OZID_59 | F0302 | 54131 | 53934 | |
| OZID_59 | F0303 | 54482 | 54697 | |
| OZID_59 | F0305 | 54763 | 54960 | |
| OZID_59 | F0304 | 54824 | 54603 | |
| OZID_59 | F0306 | 55202 | 54867 | |
| OZID_59 | F0307 | 55690 | 56814 | putative glucosyltransferase |
| OZID_59 | F1483 | 57658 | 57233 | transposase |
| OZID_59 | F1484 | 57930 | 57655 | transposase |
| OZID_59 | F0308 | 59084 | 59593 | |
| OZID_59 | F0309 | 59682 | 60305 | |
| OZID_59 | F0311 | 60401 | 60634 | |
| OZID_59 | F0312 | 61243 | 61497 | |
| OZID_59 | F0313 | 62359 | 61472 | putative transposase |
| OZID_59 | F0314 | 62685 | 62359 | unknown in IS |
| OZID_59 | F0315 | 62866 | 63912 | |
| OZID_59 | F0316 | 64153 | 64668 | |
| OZID_59 | F0317 | 64818 | 66833 | |
| OZID_59 | F0318 | 67334 | 68566 | |
| OZID_59 | F0319 | 68551 | 69189 | |
| OZID_59 | F0320 | 69558 | 70202 | |
| OZID_59 | F0321 | 70518 | 71018 | |
| OZID_59 | F1485 | 71151 | 70900 | transposase |
| OZID_59 | F0323 | 71202 | 71627 | unknown in putative ISEc8 |
| OZID_59 | F0324 | 72399 | 73310 | |
| OZID_59 | F0325 | 73514 | 76531 | putative adhesin |
| OZID_59 | F0326 | 76639 | 79026 | |
| OZID_59 | F0327 | 79023 | 79928 | |
| OZID_59 | F0328 | 79925 | 80995 | |
| OZID_59 | F0329 | 81335 | 82153 | |

TABLE 2-continued

| Sequence_ID | Orf_ID | Orf_Start | Orf_End | Description |
|---|---|---|---|---|
| OZID_59 | F0330 | 82244 | 82729 | |
| OZID_59 | F0331 | 82730 | 83221 | putative DNA repair protein |
| OZID_59 | F0332 | 83284 | 83505 | |
| OZID_59 | F0333 | 83668 | 84042 | putative structural protein |
| OZID_59 | F0334 | 84089 | 84370 | |
| OZID_59 | F0335 | 85232 | 84345 | putative transposase |
| OZID_59 | F0336 | 85558 | 85232 | unknown in IS |
| OZID_59 | F0339 | 86558 | 87400 | |
| OZID_59 | F0340 | 87457 | 86912 | |
| OZID_62 | F0342 | 1161 | 142 | integrase |
| OZID_62 | F0343 | 1381 | 1139 | |
| OZID_62 | F0344 | 3920 | 1449 | |
| OZID_62 | F0345 | 4142 | 4014 | |
| OZID_62 | F0346 | 4390 | 4202 | cell division inhibition protein |
| OZID_62 | F0347 | 5726 | 5337 | |
| OZID_62 | F0348 | 5866 | 5738 | |
| OZID_62 | F0349 | 6023 | 5868 | |
| OZID_62 | F0350 | 6779 | 6588 | |
| OZID_62 | F0351 | 7208 | 6807 | |
| OZID_62 | F0352 | 7573 | 7998 | |
| OZID_62 | F0353 | 7961 | 8521 | |
| OZID_62 | F0354 | 8582 | 8205 | |
| OZID_62 | F0355 | 8628 | 9830 | |
| OZID_62 | F0356 | 8855 | 8700 | |
| OZID_62 | F0357 | 9837 | 10583 | DNA replication factor |
| OZID_62 | F0358 | 10605 | 11375 | |
| OZID_62 | F0359 | 11391 | 11804 | |
| OZID_62 | F0360 | 12929 | 12156 | |
| OZID_62 | F0362 | 13888 | 14061 | |
| OZID_62 | F0363 | 14137 | 15186 | |
| OZID_62 | F0364 | 15199 | 15570 | endodeoxyribonuclease |
| OZID_62 | F0365 | 15551 | 15931 | |
| OZID_62 | F0366 | 16077 | 16901 | |
| OZID_62 | F0367 | 17188 | 17427 | |
| OZID_62 | F0368 | 17522 | 18235 | regulatory protein |
| OZID_62 | F0369 | 19003 | 20853 | |
| OZID_62 | F0370 | 21029 | 21355 | unknown in IS |
| OZID_62 | F0371 | 21352 | 22005 | transposase |
| OZID_62 | F0372 | 22524 | 22210 | regulatory protein |
| OZID_62 | F0373 | 23457 | 22990 | cell lysis protein |
| OZID_62 | F0374 | 24274 | 23777 | cell lysis protein |
| OZID_62 | F0375 | 24326 | 24144 | cell lysis protein |
| OZID_62 | F0377 | 24444 | 24758 | |
| OZID_62 | F0376 | 24553 | 24359 | |
| OZID_62 | F0378 | 25220 | 25014 | cell lysis protein |
| OZID_62 | F1393 | 27518 | 25668 | |
| OZID_62 | F1394 | 28000 | 27833 | |
| OZID_62 | F1440 | 28127 | 27840 | |
| OZID_62 | F1396 | 29436 | 29065 | |
| OZID_62 | F1397 | 29759 | 29376 | |
| OZID_62 | F1398 | 30109 | 29750 | |
| OZID_62 | F1399 | 31225 | 30122 | |
| OZID_62 | F1400 | 31445 | 31173 | |
| OZID_62 | F1401 | 31779 | 31567 | |
| OZID_62 | F1403 | 32229 | 32459 | |
| OZID_62 | F1402 | 32241 | 32029 | |
| OZID_62 | F1404 | 33032 | 32475 | |
| OZID_62 | F1405 | 33660 | 33355 | |
| OZID_62 | F1406 | 33691 | 33380 | |
| OZID_62 | F1407 | 34313 | 33909 | |
| OZID_62 | F1408 | 34939 | 34223 | |
| OZID_62 | F1409 | 35635 | 34973 | |
| OZID_62 | F1410 | 36476 | 35427 | |
| OZID_62 | F1411 | 37036 | 36539 | |
| OZID_62 | F1412 | 37282 | 37920 | |
| OZID_62 | F1413 | 38132 | 38365 | |
| OZID_62 | F1414 | 38365 | 39015 | |
| OZID_62 | F1415 | 39688 | 39981 | |
| OZID_62 | F1416 | 40259 | 41503 | |
| OZID_62 | F1417 | 41500 | 42036 | putative transposase |
| OZID_62 | F1418 | 42109 | 42456 | |
| OZID_62 | F1491 | 42883 | 43007 | heat stable enterotoxin |
| OZID_62 | F1419 | 43387 | 42506 | putative transposase |
| OZID_62 | F1420 | 43398 | 43799 | unknown in ISEc8 |
| OZID_62 | F1048B | 43796 | 44143 | unknown in ISEc8 |
| OZID_62 | F1388 | 46165 | 45743 | putative transposase |
| OZID_62 | F1387 | 46965 | 46315 | |

TABLE 2-continued

| Sequence_ID | Orf_ID | Orf_Start | Orf_End | Description |
|---|---|---|---|---|
| OZID_62 | F1386 | 47297 | 46950 | |
| OZID_62 | F1385 | 48206 | 47676 | |
| OZID_62 | F1384A | 48540 | 48866 | unknown in IS |
| OZID_62 | F1383 | 48863 | 49753 | putative IS629 transposase |
| OZID_63 | F1472 | 212 | 613 | |
| OZID_63 | F1473 | 1491 | 739 | |
| OZID_64 | L0061 | 1363 | 29 | integrase |
| OZID_64 | L0062 | 1691 | 1392 | putative excisionase |
| OZID_64 | L0063 | 2073 | 1762 | |
| OZID_64 | L0064 | 2498 | 2133 | |
| OZID_64 | L0065 | 3033 | 2410 | |
| OZID_64 | L0066 | 3324 | 3037 | |
| OZID_64 | L0067 | 3544 | 3326 | |
| OZID_64 | L0068 | 3833 | 3546 | |
| OZID_64 | L0069 | 4876 | 4103 | |
| OZID_64 | L0070 | 5474 | 5193 | |
| OZID_64 | L0071 | 5676 | 5485 | |
| OZID_64 | L0072 | 5837 | 5649 | |
| OZID_64 | L0073 | 6508 | 5831 | exonuclease |
| OZID_64 | L0074 | 7290 | 6505 | recombination protein |
| OZID_64 | L0075 | 7592 | 7296 | host-nuclease inhibitor protein |
| OZID_64 | L0076 | 7937 | 7668 | kil protein |
| OZID_64 | L0077 | 7944 | 7780 | regulatory protein CIII |
| OZID_64 | L0078 | 8385 | 8017 | putative single-stranded DNA binding protein |
| OZID_64 | L0079 | 9006 | 8536 | |
| OZID_64 | L0080 | 9448 | 9065 | early gene regulator N |
| OZID_64 | L0081 | 10101 | 9937 | |
| OZID_64 | L0082 | 11150 | 10104 | serine/threonine kinase |
| OZID_64 | L0083 | 11605 | 11144 | |
| OZID_64 | L0084 | 12014 | 11673 | |
| OZID_64 | L0085 | 12782 | 12075 | repressor protein CI |
| OZID_64 | L0086 | 12861 | 13088 | regulatory protein Cro |
| OZID_64 | L0087 | 13227 | 13523 | regulatory protein CII |
| OZID_64 | L0088 | 13556 | 14494 | replication protein O |
| OZID_64 | L0089 | 14491 | 15192 | replication protein P |
| OZID_64 | L0090 | 15189 | 15479 | Ren protein |
| OZID_64 | L0091 | 15550 | 15828 | |
| OZID_64 | L0092 | 15997 | 16356 | |
| OZID_64 | L0093 | 16380 | 16826 | |
| OZID_64 | L0094 | 16823 | 17350 | putative DNA N-6-adenine-methyltransferase |
| OZID_64 | L0095 | 17532 | 18581 | |
| OZID_64 | L0096 | 18727 | 19455 | DNA-binding protein Roi |
| OZID_64 | L0097 | 19455 | 20060 | |
| OZID_64 | L0098 | 20057 | 20251 | |
| OZID_64 | L0099 | 20205 | 20678 | late gene regulator Q |
| OZID_64 | L0103 | 21462 | 22421 | Shiga toxin 2 subunit A |
| OZID_64 | L0104 | 22433 | 22702 | Shiga toxin 2 subunit B |
| OZID_64 | L0105 | 23189 | 25126 | |
| OZID_64 | L0106 | 25307 | 25753 | |
| OZID_64 | L0107 | 25830 | 26045 | lysis protein S; holin |
| OZID_64 | L0108 | 26050 | 26583 | endolysin |
| OZID_64 | L0109 | 26854 | 27423 | putative regulatory protein |
| OZID_64 | L0110 | 27577 | 28041 | endopeptidase |
| OZID_64 | L0143 | 27797 | 27982 | Rz1 protein precursor; prolipoprotein; outer membrane lipoprote |
| OZID_64 | L0111 | 28366 | 28073 | Bor protein precursor |
| OZID_64 | L0112 | 28775 | 29581 | putative terminase, small subunit |
| OZID_64 | L0113 | 29562 | 31268 | putative terminase, large subunit |
| OZID_64 | L0114 | 31268 | 33412 | putative portal protein |
| OZID_64 | L0115 | 33570 | 34577 | |
| OZID_64 | L0116 | 34601 | 35815 | |
| OZID_64 | L0117 | 35871 | 36260 | |
| OZID_64 | L0118 | 36283 | 36771 | |
| OZID_64 | L0119 | 36647 | 37318 | |
| OZID_64 | L0120 | 37318 | 37968 | |
| OZID_64 | L0121 | 37965 | 39902 | putative tail fiber protein |
| OZID_64 | L0122 | 39784 | 40173 | |
| OZID_64 | L0123 | 40220 | 40501 | |
| OZID_64 | L0124 | 40718 | 42421 | |
| OZID_64 | L0125 | 42418 | 43686 | |
| OZID_64 | L0126 | 43752 | 43979 | |
| OZID_64 | L0127 | 43985 | 44602 | |
| OZID_64 | L0128 | 44693 | 45427 | outer membrane protein Lom precursor |
| OZID_64 | L0129 | 45857 | 46258 | |
| OZID_64 | L0130 | 46352 | 47008 | |
| OZID_64 | L0131 | 47011 | 47457 | |
| OZID_64 | L0132 | 47467 | 47718 | |
| OZID_64 | L0133 | 47729 | 48994 | |

TABLE 2-continued

| Sequence_ID | Orf_ID | Orf_Start | Orf_End | Description |
|---|---|---|---|---|
| OZID_64 | L0134 | 49025 | 57445 | |
| OZID_64 | L0135 | 57728 | 57916 | |
| OZID_64 | L0136 | 58340 | 57996 | |
| OZID_64 | L0137 | 58615 | 58460 | host killer protein |
| OZID_64 | L0144 | 58672 | 58460 | modulation of host killing; part of toxin/antitoxin system; prophage maintenance |
| OZID_64 | L0139 | 59376 | 58906 | |
| OZID_64 | L0141 | 60418 | 60197 | |
| OZID_64 | L0142 | 61095 | 60466 | |
| OZID_65 | F0379 | 1491 | 148 | |
| OZID_66 | F0380 | 87 | 1697 | |
| OZID_66 | F0381 | 2291 | 1764 | |
| OZID_66 | F0382 | 2692 | 2853 | |
| OZID_66 | F0383 | 3787 | 4578 | putative oxidoreductase |
| OZID_66 | F0384 | 5368 | 4724 | putative chaperone |
| OZID_66 | F0385 | 6744 | 5410 | |
| OZID_66 | F0386 | 9282 | 6760 | putative usher protein |
| OZID_66 | F0387 | 10057 | 9335 | putative chaperone |
| OZID_66 | F0389 | 10682 | 10122 | putative pilin subunit |
| OZID_66 | F0390 | 11348 | 10725 | |
| OZID_66 | F0391 | 12739 | 16551 | putative member of ShlA/HecA/FhaA exoprotein family |
| OZID_66 | F0393 | 16640 | 18259 | putative outer membrane transporter of ShlA/HecA/FhaA exoprotein family |
| OZID_66 | F0394 | 18275 | 18643 | putative acyl-carrier protein synthase |
| OZID_66 | F0395 | 18654 | 19418 | putative fatty acyl chain reductase |
| OZID_66 | F0396 | 19422 | 19970 | putative fatty acyl chain dehydrase |
| OZID_66 | F0397 | 19992 | 20273 | putative acyl-carrier protein |
| OZID_66 | F0398 | 20309 | 21469 | putative aminomethyltransferase |
| OZID_66 | F0399 | 21543 | 24101 | putative beta-ketoacyl-acyl carrier protein synthase |
| OZID_66 | F0401 | 24040 | 25329 | |
| OZID_66 | F0402 | 25326 | 26279 | |
| OZID_66 | F0403 | 26203 | 26997 | |
| OZID_66 | F0404 | 26990 | 27637 | |
| OZID_66 | F0405 | 27638 | 28948 | |
| OZID_66 | F0406 | 28957 | 29745 | |
| OZID_66 | F0407 | 29742 | 31130 | |
| OZID_68 | F1338 | 5046 | 6371 | |
| OZID_68 | F0634 | 8543 | 8271 | |
| OZID_69 | F0410 | 102 | 344 | |
| OZID_69 | F0411 | 429 | 1271 | |
| OZID_7 | F0013 | 3203 | 2094 | putative fimbrial protein |
| OZID_7 | F0014 | 3805 | 3215 | putative fimbrial protein |
| OZID_7 | F0015 | 4431 | 3826 | putative fimbrial protein |
| OZID_7 | F0016 | 5006 | 4446 | putative fimbrial protein |
| OZID_7 | F0017 | 7506 | 5008 | putative fimbrial usher protein |
| OZID_7 | F0018 | 8381 | 7650 | putative fimbrial chaperone protein |
| OZID_7 | F0019 | 9067 | 8462 | putative fimbrial protein |
| OZID_71 | F0412 | 375 | 145 | integrase |
| OZID_71 | F0413 | 1063 | 476 | integrase |
| OZID_71 | F0414 | 1510 | 1232 | excisionase |
| OZID_71 | F0416 | 1968 | 2381 | |
| OZID_71 | F0415 | 2000 | 1563 | |
| OZID_71 | F0417 | 2488 | 2261 | |
| OZID_71 | F0419 | 3658 | 3182 | |
| OZID_71 | F0420 | 4090 | 4515 | |
| OZID_71 | F0421 | 4578 | 5621 | |
| OZID_71 | F0422 | 5413 | 6075 | |
| OZID_71 | F0423 | 6109 | 6825 | |
| OZID_71 | F0424 | 6735 | 7139 | |
| OZID_71 | F0425 | 7136 | 7438 | |
| OZID_71 | F0426 | 7428 | 7745 | |
| OZID_71 | F0427 | 7687 | 8016 | |
| OZID_71 | F0428 | 8003 | 8440 | |
| OZID_71 | F0429 | 8636 | 9223 | |
| OZID_71 | F0430 | 10292 | 11341 | |
| OZID_71 | F0431 | 11354 | 11728 | endonuclease |
| OZID_71 | F0432 | 11725 | 12546 | phage late gene regulator Q |
| OZID_71 | F0433 | 13143 | 13310 | |
| OZID_71 | F0434 | 13625 | 15562 | |
| OZID_71 | F0435 | 15710 | 15892 | |
| OZID_71 | F0436 | 15819 | 16199 | |
| OZID_71 | F0437 | 16275 | 16490 | |
| OZID_71 | F0952 | 16890 | 17423 | cell lysis protein |
| OZID_71 | F0951 | 17694 | 18263 | antirepressor |
| OZID_71 | F1348 | 19516 | 19881 | |
| OZID_71 | F1349 | 19598 | 19987 | |
| OZID_71 | F1350 | 20171 | 20734 | |

TABLE 2-continued

| Sequence_ID | Orf_ID | Orf_Start | Orf_End | Description |
|---|---|---|---|---|
| OZID_71 | F0945 | 20731 | 22392 | |
| OZID_71 | F1352 | 22456 | 24393 | |
| OZID_71 | F1353 | 24438 | 24659 | |
| OZID_72 | F0439 | 234 | 1 | unknown in IS |
| OZID_72 | F0441 | 514 | 867 | putative transposase |
| OZID_72 | F0440 | 602 | 396 | unknown in IS |
| OZID_72 | F0442 | 1009 | 1242 | |
| OZID_72 | F0443 | 1370 | 1095 | |
| OZID_72 | F0444 | 2792 | 1431 | |
| OZID_73 | F0447 | 146 | 1396 | integrase |
| OZID_73 | F0448 | 1761 | 1949 | |
| OZID_73 | F0449 | 2007 | 2750 | |
| OZID_73 | F0450 | 2776 | 2973 | |
| OZID_73 | F0451 | 2924 | 3151 | |
| OZID_73 | F0452 | 3151 | 3342 | |
| OZID_73 | F0453 | 3332 | 3574 | |
| OZID_73 | F0454 | 3580 | 3879 | |
| OZID_73 | F0455 | 3876 | 6008 | |
| OZID_73 | F0456 | 6379 | 6630 | |
| OZID_73 | F0457 | 6627 | 7037 | ssDNA-binding protein |
| OZID_73 | F0458 | 7006 | 7320 | |
| OZID_73 | F0459 | 7367 | 7669 | |
| OZID_73 | F0460 | 7962 | 9119 | |
| OZID_73 | F0461 | 9159 | 9731 | |
| OZID_73 | F0462 | 9733 | 10944 | |
| OZID_73 | F0463 | 10941 | 11279 | |
| OZID_73 | F0464 | 11276 | 11572 | |
| OZID_73 | F0465 | 11572 | 12012 | |
| OZID_73 | F0466 | 12302 | 12658 | |
| OZID_73 | F0467 | 12774 | 14066 | |
| OZID_73 | F0468 | 13894 | 14304 | |
| OZID_73 | F0469 | 14318 | 14599 | |
| OZID_74 | F0470 | 1203 | 61 | integrase |
| OZID_74 | F0471 | 1429 | 1193 | excisionase |
| OZID_74 | F0472 | 1460 | 1618 | |
| OZID_74 | F0473 | 1533 | 2135 | phage replication protein |
| OZID_74 | F0474 | 2135 | 2356 | phage replication protein |
| OZID_74 | F0475 | 2353 | 3054 | phage replication protein |
| OZID_74 | F0476 | 3051 | 3353 | |
| OZID_74 | F0477 | 3421 | 3753 | |
| OZID_74 | F0478 | 3998 | 5524 | |
| OZID_74 | F0479 | 5644 | 5835 | |
| OZID_74 | F0480 | 6026 | 6481 | |
| OZID_74 | F0481 | 6481 | 6651 | |
| OZID_74 | F0482 | 6644 | 6934 | |
| OZID_74 | F0483 | 6931 | 7293 | endonuclease |
| OZID_74 | F0484 | 7427 | 8116 | phage late gene regulator Q |
| OZID_74 | F0485 | 8438 | 8743 | |
| OZID_74 | F0486 | 8730 | 9206 | cell lysis protein |
| OZID_74 | F0487 | 9203 | 9664 | cell lysis protein |
| OZID_74 | F0488 | 9989 | 9696 | membrane protein |
| OZID_74 | F0489 | 10733 | 10281 | |
| OZID_74 | F0490 | 10977 | 11183 | |
| OZID_74 | F0491 | 11542 | 11348 | |
| OZID_74 | F0492 | 11931 | 12476 | phage DNA packaging protein |
| OZID_74 | F0493 | 12451 | 14376 | phage DNA packaging protein |
| OZID_74 | F0494 | 14373 | 14579 | phage morphogenesis protein |
| OZID_74 | F0495 | 14576 | 16177 | phage capsid protein |
| OZID_74 | F0496 | 16023 | 16394 | phage capsid protein |
| OZID_74 | F0497 | 16391 | 17476 | phage capsid protein |
| OZID_74 | F0498 | 17480 | 17818 | phage morphogenesis protein |
| OZID_74 | F0499 | 17847 | 18899 | phage capsid protein |
| OZID_74 | F0500 | 18902 | 19339 | phage DNA packaging protein |
| OZID_74 | F0501 | 19351 | 19704 | phage morphogenesis protein |
| OZID_74 | F0502 | 19719 | 20252 | phage tail protein |
| OZID_74 | F0503 | 20249 | 20644 | phage tail protein |
| OZID_74 | F0504 | 20652 | 21404 | phage tail protein |
| OZID_74 | F0505 | 21418 | 21840 | phage tail protein |
| OZID_74 | F0506 | 21867 | 22226 | phage tail protein |
| OZID_74 | F0508 | 22263 | 24875 | phage tail protein |
| OZID_74 | F0509 | 24872 | 25201 | phage tail protein |
| OZID_74 | F0510 | 25201 | 25899 | phage tail protein |
| OZID_74 | F1426 | 25739 | 26653 | phage tail protein |
| OZID_74 | F0512 | 26551 | 27228 | phage tail protein |
| OZID_74 | F0513 | 27469 | 28644 | phage tail protein |
| OZID_74 | F0514 | 28521 | 30941 | phage tail protein |
| OZID_74 | F0515 | 31009 | 31608 | membrane protein |

TABLE 2-continued

| Sequence_ID | Orf_ID | Orf_Start | Orf_End | Description |
|---|---|---|---|---|
| OZID_74 | F0820 | 31667 | 34588 | putative tail fiber protein |
| OZID_74 | F0821 | 32919 | 32170 | |
| OZID_74 | F0819 | 34588 | 35169 | putative tail fiber protein |
| OZID_74 | F0818 | 36179 | 35289 | |
| OZID_74 | F0817 | 36704 | 36198 | |
| OZID_74 | F0816 | 37247 | 36741 | |
| OZID_74 | F0815 | 37502 | 37320 | |
| OZID_74 | F0814 | 38668 | 38000 | |
| OZID_74 | F0813 | 38725 | 38973 | |
| OZID_74 | F0811 | 39426 | 39773 | |
| OZID_74 | F0771 | 39823 | 41361 | |
| OZID_74 | F0808 | 43148 | 41664 | possible protease (ompP-like) |
| OZID_74 | F0807 | 44288 | 43335 | putative OmpT-like protease |
| OZID_74 | F0806 | 44770 | 45105 | |
| OZID_77 | F0522 | 933 | 43 | transposase |
| OZID_77 | F0523 | 1256 | 930 | unknown in IS |
| OZID_78 | F0525 | 2827 | 1973 | putative molybdenum transport protein |
| OZID_78 | F0526 | 3636 | 2992 | |
| OZID_78 | F0527 | 4404 | 3646 | putative iron compound ABC transporter, ATP-binding protein |
| OZID_78 | F0528 | 5381 | 4401 | putative iron compound ABC transporter, permease protein |
| OZID_78 | F0529 | 6403 | 5381 | |
| OZID_81 | F0530 | 1174 | 44 | integrase |
| OZID_81 | F0531 | 3936 | 1465 | |
| OZID_81 | F0533 | 6911 | 7066 | |
| OZID_81 | F0534 | 7593 | 8480 | |
| OZID_81 | F0535 | 8420 | 9085 | |
| OZID_81 | F0536 | 9272 | 9853 | |
| OZID_81 | F0537 | 10713 | 11471 | |
| OZID_81 | F0538 | 12790 | 13836 | |
| OZID_81 | F0539 | 13849 | 14208 | endonuclease |
| OZID_81 | F0540 | 14217 | 14747 | |
| OZID_81 | F0541 | 14866 | 15186 | |
| OZID_81 | F0542 | 15337 | 16395 | |
| OZID_81 | F0543 | 17296 | 19041 | |
| OZID_81 | F0544 | 19490 | 19696 | |
| OZID_81 | F0545 | 19698 | 20045 | |
| OZID_81 | F0546 | 20096 | 20629 | cell lysis protein |
| OZID_81 | F0547 | 20903 | 21598 | antirepressor |
| OZID_81 | F0548 | 21821 | 22294 | cell lysis protein |
| OZID_81 | F0550 | 22618 | 22959 | membrane protein |
| OZID_81 | F0551 | 23333 | 23698 | |
| OZID_81 | F0552 | 23987 | 24550 | phage DNA packaging protein |
| OZID_81 | F0553 | 24528 | 26207 | |
| OZID_81 | F0555 | 26271 | 27884 | |
| OZID_81 | F0556 | 28419 | 30998 | |
| OZID_81 | F0557 | 31001 | 31327 | |
| OZID_81 | F0558 | 31337 | 31687 | |
| OZID_81 | F0559 | 31684 | 32130 | |
| OZID_81 | F0560 | 32127 | 32471 | |
| OZID_81 | F0561 | 32468 | 33271 | |
| OZID_81 | F0565 | 33996 | 37076 | phage tail protein |
| OZID_81 | F0566 | 37111 | 37410 | phage tail protein |
| OZID_81 | F0567 | 37410 | 37847 | phage tail protein |
| OZID_84 | F0661 | 1059 | 1454 | |
| OZID_87 | F0659 | 179 | 742 | putative type 1 pilin protein |
| OZID_87 | F0658 | 1014 | 1814 | putative fimbrial protein chaperone |
| OZID_88 | F0655 | 823 | 602 | |
| OZID_88 | F0654 | 983 | 1492 | |
| OZID_91 | F0651 | 574 | 365 | |
| OZID_91 | F0650 | 795 | 574 | |
| OZID_92 | F0646 | 4422 | 2278 | |
| OZID_93 | F0645 | 420 | 43 | |
| OZID_93 | F0644 | 976 | 545 | |
| OZID_93 | F0643 | 1331 | 963 | |
| OZID_93 | F0642 | 1731 | 1306 | |
| OZID_95 | F0640 | 3892 | 818 | |
| OZID_96 | F0639 | 836 | 195 | |
| OZID_96 | F0638 | 1547 | 918 | |
| OZID_96 | F0637 | 2195 | 1620 | |
| OZID_96 | F0636 | 2577 | 2308 | |
| OZID_96 | F0635 | 3148 | 2579 | |
| OZID_98 | F0631 | 3745 | 272 | phage tail protein |
| OZID_98 | F0630 | 3879 | 4406 | superoxide dismutase |
| OZID_98 | F0629 | 5274 | 4597 | phage tail protein |
| OZID_98 | F0628 | 6086 | 5172 | phage tail protein |
| OZID_98 | F0627 | 6624 | 5926 | phage tail protein |
| OZID_98 | F0626 | 6953 | 6624 | phage tail protein |

TABLE 2-continued

| Sequence_ID | Orf_ID | Orf_Start | Orf_End | Description |
|---|---|---|---|---|
| OZID_98 | F0625 | 7714 | 6950 | phage tail protein |
| OZID_98 | F0624 | 9528 | 7666 | phage tail protein |
| OZID_98 | F0623 | 9922 | 9509 | phage tail protein |
| OZID_98 | F0622 | 10452 | 9949 | phage tail protein |
| OZID_98 | F0621 | 11023 | 10394 | phage tail protein |
| OZID_98 | F0620 | 11382 | 11116 | phage capsid protein |
| OZID_98 | F0619 | 11787 | 11440 | phage capsid protein |
| OZID_98 | F0618 | 13329 | 11824 | phage morphogenesis protein |
| OZID_98 | F0617 | 14911 | 13319 | phage morphogenesis protein |
| OZID_98 | F0616 | 15114 | 14908 | phage morphogenesis protein |
| OZID_98 | F0615 | 17062 | 15098 | phage DNA packaging protein |
| OZID_98 | F0614 | 17507 | 16998 | |
| OZID_98 | F0613 | 17902 | 18126 | |
| OZID_98 | F0612 | 18522 | 18208 | |
| OZID_98 | F0611 | 18904 | 18764 | |
| OZID_98 | F0610 | 19454 | 18987 | cell lysis protein |
| OZID_98 | F0609 | 19866 | 19606 | |
| OZID_98 | F0608 | 20095 | 19859 | |
| OZID_98 | F0607 | 20477 | 19944 | cell lysis protein |
| OZID_98 | F0606 | 20872 | 20564 | |
| OZID_98 | F0605 | 21083 | 20877 | cell lysis protein |
| OZID_98 | F1486 | 21403 | 21729 | transposase |
| OZID_98 | F0604 | 21726 | 22616 | transposase |
| OZID_98 | F0603 | 22582 | 22917 | |
| OZID_98 | F0602 | 24548 | 22698 | |
| OZID_98 | F0601 | 25126 | 24959 | |
| OZID_98 | F0600 | 25253 | 24966 | |
| OZID_98 | F0599 | 25626 | 25123 | |
| OZID_98 | F0598 | 25843 | 25505 | |
| OZID_98 | F1373 | 26030 | 26296 | |
| OZID_98 | F0597 | 26790 | 26116 | |
| OZID_98 | F0596 | 26957 | 26667 | |
| OZID_98 | F0595 | 27555 | 27046 | |
| OZID_98 | F0594 | 27709 | 27458 | |
| OZID_98 | F0593 | 28055 | 28963 | |
| OZID_98 | F0592 | 29077 | 29445 | |
| OZID_98 | F0591 | 29442 | 30434 | |
| OZID_98 | F0590 | 31553 | 30402 | cytosine methylase |
| OZID_98 | F0589 | 32242 | 31985 | |
| OZID_98 | F0588 | 32403 | 32242 | |
| OZID_98 | F0587 | 32470 | 32309 | |
| OZID_98 | F0586 | 32744 | 32481 | |
| OZID_98 | F0585 | 33208 | 32996 | |
| OZID_98 | F0584 | 33736 | 33314 | |

SEQUENCE LISTING (265 sequences)

SEQ ID NO: 1 - DNA  (genomic), 6506 bp; double-stranded, linear
tttaccatactggatttcattcgtaccatcattggagagttgaaagcctatttgacccgcaccgtcctcactgttttctaactcattttttaatatgctggttcctgactcctgtatcgtcactggttcaaagtaatattcaacgtcactgggttcaaaaactaattcaccttgctcgccctggatgcagtcaaatcttatatgatgaaactgataattttcattattgatacgagacagtacaaatagtccagtgtcgatggattgatcttcaaaaccacaggtcattaaatttacctgtaaaatagtatttaaattaaaattaaagcggacgctattacaattagtattattccctgtacatgaactcacttcaatttcgaacaacaaaggaaaaggagttcctggaaaaatatctgcggtgttggaactatctgatacagatgcgatagagtatggaatggtgaaatttatcgcagatagcatttcttctaaattataagatgacttccctggaagcgctattttttttaccgtcagattcaaaggggaaattaataatataatgacgacttccgactttaaaccttaaagcgttctgtgttaaaaaatgaactttaatggcgttggtcgtctcttgcaagtctgcacactcaatgatattcccagtattttcaattttttcggcggtgagattacctttcatactcagtggtttgagtatatatgttccacgttgttccccgacattggtcaatccacagggagcactttgcacaataaaagaatatagactcaatgtgattaataaaagccacttcatagtaaactccttttactggcatatatatgttttgttttcatcgataacgtgttgaaaagtaatagtacagaataaattctgttcatcattgagagcaacttttatgccagttggaatttcatctacgcgaataaaaaggcgactaccctggccaacgactccaatattgttttcctggagatccagtacgtcatagccaaaagttaatggcgaaccatcgggacgcagtgcctgtatataccagggcttacgttggtcagttgtaaactgcacataagaaactgctccacggtaaggcgcaataatttgacgattgccctgcaattctgtttcactttcactgtttgctgtatcaagtaccagatggttttcacgatgaggtatcatcaggtcgtaaacaacctggcctttgctgtttgttcggttgtatttttgtccattaatatgcgcgccttctaacccaggcgcatccagaattgcaaatgtatcggatagctggttagtgatattaataccaccgggccagacaactaatccactactaatacttccaccactttgccaggcgtttttagaatggctatagctgccatctattgtggcgatgggagttctccagcttaaattcgtaccaagcgatgtatcattattttgttgttgctgattaacatatataccataatttaactgatcatgttcaccggctatgccagtaattccagtattgttggaggaatagccatctttggaaaatgaggtcgaattcgataagttaatttggtgacgtgttttggcaatatcatccccccagtagaaaggaatggagataaacagattaaaacgctcctcttctttgtcgttttcatcataggattggctggcagagaaagtataactgatgcgttgccagctattggaataactgaattggtaatctttagcatttccacttcgcccccagtaattccgccaaagcgcacttaatgatacatttcccagattattggataaaggttgcatgatattggcagaaaggctattttttctgccaatatcataaaaatcgtcatagtcactctgatgatttattttatcattttcgtaaagatggtcgctgaatgtcctgtaatcctgcgaagcataacgccaggcggccacgctaaatcgagtggccgtttgtactagatatttattataggcgacctgatagctcgtaccttcgtgtgttatatcattatttaacttactactcgatcgtgtagcgtcaaaagagatggcacccagcggtgtattccaaccatttcccagagttatagcattatagttatcggataaaatcgtaccgccataaagtgtcaaaagattgttgaggccatatatataatttgcctcgagaaagtcctcctgattctttacaccatatatcttactgcgtccggcgataaaatcgaaatttgaaataccaggttgcagcatgttaggcacggaagagtagggcaccaaaaaggaacgaacactgccatctgcttcctttatgctgacatcgagatcagagccgctgcccgagagttgcaaatctgcgatagtaaatggtcccgggggaacctctttttggtaaatgatgtagccattttgcgaaaccgttatcaaggcattactttgcgcaacaccttgtactaaaggtgtaaagctctgcatagaatcaggtagcatttgcatatcgcgaaataagcgtattccgctaaatctcagagagtcgaatatgagtgaggatgtgtaattttctcctatctgaactgtgcttaatatctgcgaccagccatgttccaggtaaagagtattactttgccatgtgcctttcatatcatcgggtttgctatagctggcatcagagtgtaactgccaactaaataaatttaatccactgttaaatcggccataactggctgtattactgttattattgctgtcataagagcgatactgacttaaattataggaggtataaaaagcatcaatgccgcgatcccaactttccgggggaacgtaacctctttcaagttcattgatatacgcctgtggtactgttaaatttagtcggtgttcactgatatcccactgatattgtccaccatgaaccgctttatccagtaaaatacaattatcttctgtattgaggttaccggtctttacccccagtttggttagtagcaccttaggcagacatggtttgactggtgactctgggatcgtgatatcttgttttccacgccactggttatttacataaaaatcaagttcgtagtttcctggaagcggttgtttattatcgaaatgatattcggaaactttttctcctttcatgccgccgatcataaagtgcgtatcaaaagtttcttcagcataacccggaaaagaatacaaaaaaataatagcagcgacccatcgtgtcgtccttaacatgactttttcctgttatctcgcggcgattttactatggatgttattcccgtaatcatcaactaccgttagttcatattctgatgcgtggttattttttaatgtaatgtcgttatgcgaaaagggaggcagtaagatactttcattattaactttcacgttttgtgctttgatagttgtaaccgttatccagttggctgtttcgttgtttattgagatggcgttatttttctttttgatatttaattgagaaaggctttttttatctaccggagctattccgcttggacgccaaagtaactttatccggttttgcaatgcaagtttaattttgtttttccctgcattttgtggattgtttggagggatatccagaacatttagataaaataaactttctttattgtgaggcaaattgtttggcatttttcttattttaagttgttggccagaaccacctgctacacgacttactggcggtgtgagaataaatgtgacctgaattttttctggcgcgatagtggtgttcccatcatcgatccatgcctgaatcaaagaggcatttttactttgattcattaactgtacgagaacttctctgtttttttccggataaataatgcgcgtaccatagatgaccacaccggcatgaacaggtaaaataaaaaatgacatcagtaatgctgttattattctcacgtaatcactccgtaaataataccggtagcagagctaccggcaaaaaacgttaatctgcactgattttaatcgttacggttgactctacggagccttttgtaacaggattgccacttgtgcgggcatattgtgcatttaaattgagaaaatattgaccagagccattatctttcagcggtgtttttaaccctggtctcattctggtcaaagtcccatcatcgaggaaaatggcaaagccaatgttctcagcagttcctttattcagcgtaaagttattagcatcaaactctgatgctagtacttcgatacttggggctgtatttccgtcacactgaatttctaagtcatgagaggttgaaccggtttttaaagtatagatttcattattgataagttgattcattgcactggttacaacatcttcgacaacgatatctgttgtcgaatcaccattaacaaagtaacacgttgtatcaacaacttctcctctaatggttagtgttccttgatcgacatccttggcgaaggttgttgcgctaaacatcaacgttgtcgcaacgaagggaataatatactttttcataaatcatccttaattaactggtatggaaggtcactcgttttcaaacccgattatgtgatcaggttgttattatttagattaatgtttaaattttttaatttcttgatgtgaagttgatgaaagtttgaaaatttaatattcttaattattcccttctttataagaagagcaaggtgccatcattagagtgacagagtaggatgtttcagagcatgcttcagattattttttatttctctgcagttaattaataattatcacaggtaatttcattctgaaattacttcttttttggggtgttttaatcttgatgagatatttttttcataaggaacatagactcgttgatgctctgaaggtattttctcatttctggggatgttttgtcgtaatcgtgcataaactttttcagttctttatacacatcattatttagctttacattgtcgcgaactaaagtttgtaccaatggtatcaaaatttcgaaacgggacggtttgtcatcaatacttgccagggttttgaatactcctgtgtatctgtaacctaagtgcttattgacaagttgagtggtccatcggccaggcataatatcttcacagcgcaaattttttatcatggtattagtgaacgatgttccaaatatgttgctttttttaatgaagaggttgtttatttctccatttgaaaagatggtgtttgataagtcgctttcaaaacatgatatattggataatacacaaccaaaataatacccatatgaaaggttgctcttttctattgttatatttgatagcaacagtttatgtatattaatattaagggcagtcaaatactggatgttttgctcgttaagttcatgcatctccagcgatttattatagggtaataaaagtataaattcctttacattatctccgcagtaagaaaagacaacatcaaatttatcggtgatcatgttttcatttgagcagtaagctgatttctctattaaccgactgggcgagctttttaataaagataatttttcacatagttgtgaatatgccgcattgctagttttaaaattctgccatgttattttctggttatcatctgtcgatgaggcggggattttattgcattgctcattgtatagctcaggataaatattcttttttattagatttctgatttccttattaaaataactttttttcttgactattgcactgtacttagcgttttgtgacgtctcctgatgatcataaaatgactggagatttctgcaggcctcataaaatatttcaggagtgtatagctctgggtatatttcctgattgaagtttgcctttaaaaatttaataaatttttcatggcattcttgatatatcttaatctcttcagaaagacattcgcttgttctgtcatcaaaaacatccaatctaagtaatgtgatgcctttgtgtttaaaaaaagaaaattgaactgtatgttctatgagtttacatctataaaaatgtgcatctctcagatgagtatattgaaaaaaatgatggaggactggagatggtttaggcaaatcctggcttctgaaaaagtcatcaaacaaaattaagaactctgttttatactcgcaaaacacttttactaactcattttgtcttgttttatttattattacatcatctactatatttgatttataaagacaatgtggcgaagttgagataccatctgtcattatcagtccttgaagttgatgaatttttattaatttaatttatgagtgaatgtgactactatcaaaaatcgctcattaattttaagaagtacaatataaataggtatttaacctgtgttgattgctgttaataatttacaaggtctaatgaggagatatttatgaatggttaaagtatataggaatttaattcaaaaatagagtggtcttaagtttaa

SEQ ID NO: 2 - DNA  (genomic), 41 bp; double-stranded, linear
ctacggttgctctccagcagagttggataaggcgtttacgc

SEQ ID NO: 3 - DNA  (genomic), 635 bp; double-stranded, linear
ttagaattccggcatcactgatacgtgcagatatccgtgtatactagacgtataaattgtacaggagcacgatatcatgactgcaaaacgtaccacacaaagtgtgaccgtcaccgtcgaccgtgagttagtcaatcgcgctcgtgatgcaggcttaaatatgagcgccacccttacggttgcgctcaatgctgaacttaaaaaacatgcagcaacacgttggcgtgaagagaacgctgaagctatcgctgcgttaaatcaattggctgatgaaaccggatgtttctctgatgagtaccggagcttctagcgatgcaatttacggtataccgcagtcgcagcaggaacgccgcgtttccctttgttatcgatgttaccagcgacattattggtgtgattaatcgccgtattgttattccattaacacctattgaacgatttagccgtattcgcccaccagaacggcttaacccaatccttttactggtagacggcaaagaatatgtgctcatgacgcatgagactgcaactgttccagttaacgcgctgggaacgaaattttgcgatgccagcgcgcaccgaacgttgattaaaggagcattagattttatgctcgacgggatttaagacgcgac

SEQ ID NO: 4 - DNA  (genomic), 1010 bp; double-stranded, linear
catagagaaggcgtattaaaaaagccaatattcgttcagctatcaagagcgtatttgcatagctggagagcgttgatccgaaagaatcccttcgctacagtcaaaataggtaacgtaaccgtttattgcgtgaatgagcgatttttgacagtattcttattcaggacgcttattctgagttttttattcagagtggagctatcagcatgaaagtaagaaacccagaacagattagtatccctgctagtaataccactaaagatccaggccttactaattctcagattatcaggatggctaacttggtcaaaaagaccgagaatatgaatatctttgaagagctatgggagacgttacgcaatctcttccagtcagataaacattcccagactgcggcaaggcaaattctgaaggatgcattttatttccagaatagtgatgactactcaaaatactttaccggggctgtcgacgggaaggcgcgtgataagttaactcactggctgataaaatttaatgaactcaaagaatacgcaaaagatccggaaaatatggccgcgaaggcctcactctcgccagaaggtacgttatgcgtcagtttttttattggcgatgaggcgatatttactctggagttgcagctgaaaaagagcaccaggaccggggggattgatctgagtaatgcttactttaacggggttgtcatttgtggtattgactgtctcgaggttgacctgagcaatgctgaaacgaacaatagccgttggtatgactgacctgcgcgaggttaacctgaaaaagctgacctttccggccagaacaaggctagactgcgccgttattgattaactcagaatatgaaagaggggctggaatgccccttctttaatcttatttgcgacgctaatcagacgatgcataaaacagagaaaatataaaagtaatgtattttatcattccgtctgaatataaaaaatgcgctcatgaccgccaaaaggcgcaagctactc

SEQ ID NO: 5 - DNA  (genomic), 35 bp; double-stranded, linear
ctttttggcgattgagtatcggacggtgtacaaac

SEQ ID NO: 6 - DNA  (genomic), 30 bp; double-stranded, linear
ataatgggcgtcataaaaaaaacgtcagac

SEQ ID NO: 7 - DNA  (genomic), 9381 bp; double-stranded, linear
taagttgtctgcgttatgaataattgcttacagacgccatcgccatgacgtggggcaaattaataattggcgccatcagccgtagcgccagttatactcgtcatacttcaaattgcatgtgctgcgtctgcgttcgctaaccccagtcacttacttatgtaagctcctggggattaatgagagacatccatgtctctcaccgaaggccagcctgcggctgggcaaattcgttcctgacgaatttgtcactcgcttgccgccttcctgcaacttgcaacttgaattatttagagtataagtattacgccagctcgaccattttgttgtcgatcaggcgagcatcgccaagccaggcggctaccagaattactgcccgtttgctggtttcagagacttccagcaatgtgtcggcatcgcgaatctgaatatcatcggcgcggaagcctttttcattcagttcttgcccggcaatagcaataatttcatcgagatcccgttcgccagcctgcaatttgtcggcaatcgaacttaaaactttgtacagaccgggcgcaattttgcgttgttctgccgtcagataaccgttacgggaactcagtgccagaccgtctttggcgcgcataattggcacaccgacaatctcaatatcaaagcccatatcagcaaccattttgcggatcagcgccagttgctgaaagtccttttcaccgaagcaggcgatgtccggctggaccaggttaaacagcttgctgacgatagtcgacacgccgcgaaaatgccccggccggctggcgccttccagcatggtcgaaagccctggaacgtcaacgtaagtatgggtttcagtaccgttcgggtagatctcttttaccgagggcgcgaaaaccagatccactttgcgcttgttcagcttttcgcagtcttcctgcaaggtgcgtgggtaccgagccaggtcctccgggcggtcgaactgcatcgggttaacgaaaatactgacgacgaccacatcggcgcgggctttggcttcgtcgaccagcttcatgtggccatcatgcaggttgcccatggtaggtaccagcgccacgcgcttgccttccatacgcaggcggcgaatttgctggcgcagcagtggcagggtttcgataattaacacaacgtcactccttaatggaaactgtgttcttcgcccggataaacgccggactccacttcagccatatactgccgcaccgcagcgcggatgtcgcccgtttcagcgaggaaatttttggcaaatttagggatatgaccgccggtaatgccgaacgcatcgtgcatcacgaggatctgcccatcggtaacgttgcctgcgccaataccgataaccgggatcgccagcgcttcggtaatacgttttgccagttcaaccggcacgcattccagcaccagcaactgtgcaccagcggcttctaaggctaatgcatcgctaagcagtcgatcgctcgcttcatcgccgcgcccctgaactttgtagccaccgaaaatattcactgactgtggggttaaacctaagtgaccacatacaggaacggcacgttcggtcagcatttttacggtttcgaccagccactcaccgccttcaattttgaccatgttagcaccggcacgcataaccgttgcggcgttttcaaaggcttgttccggcgtggcatacgccataaacggcaggtcagccaacagcaggcagtttggcgcgccacgacgtactgcggtagtgtggtaggcgatatcttcaacggtaacgggaagggtagattcatgcccctgaacggtcatccccagcgagtcgcccaccagcatcacgttcagcccttcctcggcaaacagttttgcgaagctgtagtcgtaggcggtgatggtggcgaagcgttttttttcctgcttacatttctgcaatgaagcaatggtggtcggtttcataacgtatcctgatggctaaagtcagattgatcgcattctaacagccgaaaacagggaggcaatggttattagtgtggggaaatgttcgcaccagagcagaactctggtgcgatgaggagggaatgacgttttacttattcgtaggtaaaggagaaggtcgcgttacctgaaaatgttccaacaccgacagcattaccgctaccatccggtaccagctgcgccgtaaaaggtaaaaacagcaggttgtttgaccaggcggcgaagttgtagtcaaccgtgttgctaccatctgcttttaacaatactttgctattgtcataagttgaatttacttttacagccacgcctgaagccgagccagtcgttttacccaccagtgtggcatcgctgggtttatttgccgctttcaacttaaccgtaattttactggcataacagtattcagcacggatagaaaaagggatttcccgcgtaagcccatttttcacttccgaaacatagctgttcccaagcgttacctgattgccactgacgttgccctgatcttgtgccagggcaactgttgcacaggtcggttcatcgacgaaaaactttaaagagtcattgtcaatgtaaaagttgatccacggctggtcattggtacctatataccatgacgcaatctttcctgctatcgttgttccgctggaaacaccattcttgggtttaaattcaggagttatgaataagcgaaaacgtaaataccaactttgatcactgtactcataggcccatttcgtctgggtgcttggtatgaagttatctgcgccactttgtgcaggtagccataaatcaagttcatctgcggcaccacaactaaggcataataactcgacagaatacacaatgcctggaacagttgtttttaataacgctgcgccattcgttgtggtgtacgtggatattaaacttgggtcagctgtattaagaaagtgaactgccttactatccccaagagatttacaccctatggcatcgcctcttagttgaatatttacatcccatgtagcttcggctatttctgtcggaacctcgaccatttgtgacgccagactaagctgagtagagcttatcttcatgtgataatccccttcagcatttctctctatataacattcattcgccaatgcataccaggatgtggtaaaaaatagcagtatcacactgcataactgaatcaacagtttattgcctttcctttgcataattatccttattattcgtaagatacgttaacaataacctggcttctcaccattcccgattcaggaggaagggcattattcacccgctgcatacgggaataaaaggtccaggttgagggaacagcattgccaggtgctaccgaataaattgctgttgaggaaccatccgttcctcgcacgttaaatgtctgctgattcggttgggccgaaaaaatcacaatgccgacgtttttcgccccggtagcctgctgttcatattcattactaaaaatttgattattcgcctgtgcaagcgatcccgcctgcggctgaaaatctaatttcatttgcgactgtgtcgtttgaatgttatcgcaagagaccacattcacattaaacgttttgccacccgcataatccgttgtcggggttacattgtcggcaaaatagtccagcgtcactgtgccgagatcgacaacgccattattactgacttcaacctgacaggtgctgggcacgatctttgcggtgagatccacatcctggccggaataggcaaaaggcgtgataagggctgttgccagccctaaaaagtgtacgattttatgatgcctgcatagcattctaatatccttatccgctattactgataagtgatcgtgaaagtcgtgggagagcggaaattacccggtcttacatcggttaccaatctaccttccgcaacggtcatccgtgcacttaacgggtaatcgtaaggctgagttgtggtgtcggcgggaagcgtcacaggcactggtatcttttgagcacaatggaattgcgtactgccattgctttccggtgtatctgtagtccatacttccacagccgttctggttgctgcgctagcgtcagtaaacttgttagaaaaacccgccgatgacgattgagaaccagcacaggatataccattaggtgccagcactatttgggcgctgttttggggaaggccagagcaattgctaaagcgaattttaaactgttgcactttgctttttgcaccgagttcagaaatataaacattgccaaagaccacttcattgatcactttattactattatccattatctgagcactgcaggtacccatagtcaggttactgtttacggttaaagaagcggacgttgtactcgcagaagcaaaattgctgttaaagcttacacccacggcaacagtagcaatcagtgtagcgatgacttttaatttcatggtggctgtccctgttattcgtaggtgaagttaaaggtggcttttgcctgaaacgcaccggtgcgtcctgctcccgccgttgtttcgcgcagtgctacggtcagaggcacaccgctggctttctcatcggcgctccattcaaatttgtcagtattattgggtgtgaagaaagtcgagtctgcggtatctctacgcttaatccccatccccaccccagcagcgccagaggttgcttcattaacaattaacttaccggaaaccgttgttcctgtaagtgtggtaaaaatctttgagtaaccattgctgcaatcggaggcctttaatttaaagttggcctgagcttcgggcgcagcggtagcgactttatccagaccaacatcaggaattgtcaggctgtattcatcgttactaccggtcactgctggaccaccatcttccactatagttatcgtgcaggtggtggctaatacggtggccgtaaaatcgacattaagatctgttgcagagccaaccgccggtaaacccaggcctattaacgcggatgttagtagtatccttttcatagaattttccatattagtgatttgctacctgacaggtaagattgttaagtaataaggtgttggtgcttccctgcgtttgtggctgcgccgggaactggtagtgcaacttacagtcaatggtttggttgttttcataccagcgcacgattaattccccgctgtcgttaataccgcgtacaaatgcctgaccaccctggcccatgctgccgatcatcacctcaccctggtaaacctccgcagcaaacggaatggatttgccattggcggcagtaatattcagcacggcagaacgcccctcgtcagtttcgaaacgggtcaaaacaacggagccgctacgtggtacggtggtggcgctggtacttttcagttcaacatcgttttccagtgtttcaatgttcagacctacccggttttcacgatatgggctgacagaggacgtcacggcatatccccagcgatcgatttcgttattactgttattgattcgtgcgcctttagcacctagggcgttgattaacaccagcgtgtcgttactgctgaaactgttgttagtgaacgttaaaccaccactgtgtaatacaaagccgccatcggttgagatggagtactgttggctgttatcagaagtggccgaggccgaagcggaaataccgcctaacccagattcatagttgagataaccaccaacagaggctaaatcgccggcgtttttatcgaggctataacctgcgttgacactgtagttcaccagattgttttcagtgttaccggaactgttaacattcaactgatgtgaaccatcgaaatcggtattgagctgagtatttaaattgcggaaaccagaagacttacgtttgccacctaaaatattctcaataggtacgctaacgctgacgtacatcgcgtcatctttctcgccgtcttcattccagctacgttgtaggttgacgctgaaactgccccacgaaacgcttttactgtaaccaacattatattcagtgcggctattgttcgccgcccagtaatacgtccagctaccggaaataaacagcgaaccgtaatcttcataggcgatattcaatggctggttaatgctgacggtaaactggtttttcatacgtgagtacgtctgcatggtgtttttgtcttcatcggcagacaaatgcttggcgtcgtcaatgaggactaacgcatcatgcaggcccaggtaatcctgggtggaatagcggtacgccgcgaggttaaatgatgtcccggtatcctggaaaagtttgttccaggtcacgcgataactttgcccctggtaggttttatcatccggaatttcagcacgggaatgggtaacgtctaccgcaaaggcgccgatgctggtgttgatacccacacctaacagcccggcaagatagttattatcggtgaactgaatgccggtataacccgtgaagaggttattcagaccatagtaataagaggcttgccccatattgggttcggatcgcagactgtcatcaatgactttacccgcgctgaaatcccaacggcccacaccaggacgttgcatttgtacaaccgacgagaaggggtgcgtaaaggtgcgtttggaaccatccgcttcttcaatggtcacgaccagttcgctaccaaagccggaagggctaatgtcgtctataacaaattcaccgggcggaacggtggtttcataaattttatatccgctttgcgtcacggtgactttggcgttggagtttgctacaccgcggatggtcggagcgtaactggccagcgccgaaggcagcatacggctgtcgctgtacaggcgaacaccacggacgttgacagagtcaaacgtttcaccggtggtataggcatcacccataattatctgggaacggattgccggaatgtcacgctgtaagtaacgatcctggaaatcgaaatcgctgccgttatctgttgtccagttatagttaccgcgcgcacgaaagtgccaggctcctaaattgatacctgagttgaacgcgccatagacgctgtcactattgtcgttatctgaacttgtgtgatacgcgttcagggtatatgccagtgtggcagcgttaattcccgattcccataaagaagggtcaacgtagccgccatagcttttcagaacataggcctgagggatcgtcagatcgagaaactggtcactaccgtcaaagcacacatccgccttttcgtatgactttgccagatccagacaatcctcttcttcaccttctctggcgagtaaagtgacaggctgttcaggttgcttaatgtgaagttgcgccaggtttttatgggtaagacaggccgccgcactgttttcgccaatatccacaaacggaatttctaagctggaagtcgcctgaccgtttacaaatacgcggacattatagagacccggcggtgtcgggttgccttgagcataacgtttaacatcaatcgttgatgcgccagttcccattaaaaaggaactgtcatattccacggtgtccgccgcagcaccgttgctgctataaaacagggcacaacaggccgcaagtagcgtttttttcgggatacggcttttttgatgagtaaactggtacaaggttgcattcctggcgatgttaaaaagaatccgtttattttttagaatgttgcggaaccatcaatgttgccgccaaagtcgttgatcgctttaaagaccacttttccggatgacacgcttcctggcagactggttacgccaaagcttgcctggctgaacggcgtgaccatgctggaattgacgttgtaggttttgccgccgctttccagcttgacctcattaaaggacacgtaatatggcgttgggttatttgcctgtaactgagcgttgtttaatttccaggtgattttcgccggtgcttcagccggttctccctgtaacccactcgggcgataaaagagtttgatgcgtgtgcggaaagccagctgtaacaagtttttgtcagcctcagcatctttcggcttaggcggcacttccagcacgttaaaccagtagacgctttcacggtctttcggcagggctgttgcaccggtatacatcacttttacggtttgaccgcgttttggctccacgcgtgaaactggtggggtcgcggtaaacggcactttgatctggctgggatcggcattgtcatcgcccgtatccaaccagttctgaatcagtaaggggcgattccctttattttccagacgaacgttaacatcttttttatcagcgttataaatgatacgtgttccggaaataataatgtcagcgaatgctggtgcactggctaacagagtactcacaaataatgcactaaccgtttttttaaccaagggaaacataagcactccttgctgtctgtagaaagattaaattcgcgaaaataaggtttgcctgctggcaaaccttatgctcaacacaccatcaattacttataagcaacggtgtacagcgcgttagtggttacatgaccagcagttacagccgggctgttcggtgctttaacgtaagatgcgttaaatacgtactggcctttaccttctgcgtctaatgtcagttcctgaacttcagaagagttgttcatatggacctgcttaatttcagcagcgccagctttgtttttcatgttatgaactgcaatgtttacgttctgagccggtgcaataccgttaacagtgatgttcatattgttattcagggtaccgctggtgttcgcgtaacttgcagaacccatagttaactcagcattcttcggagcacctggatcacactcaacagaaatcatgaactctttcggcagtaaaccgacagcagttgcgctaacttcagcaaaagtatcagtaacattcgcagtatccagggtaaccacgccatcagtggtaacgctatgcataccagtatctaccacacccactttacaggtaccggactgtaccataccgttaaagtcgatatgaccaccatctacagccagggcggaaccagaagccataaccagagcggctgcgagaagtgcttttttcattacatgcatccttacaaaaattatatgaaattaatattgcgagcggatattactcaaagtttttggaggatgtaataggggtgaattatcacgggtgtgaatatatttacgtggtgtattgaattgttgctattctaggttttttaaacaaaaaatgcctaatctatttgcatgaagtgctatttcatgaattaattaaaaaaaactaaaatgtaaattaagtatatttaatctgtaagaggggaagtgaggagtaagataagaaaataaaataatacagctaataccagatggcaggttgtagtactgctagcgaagtgagt

SEQ ID NO: 8 - DNA  (genomic), 32 bp; double-stranded, linear
aaaatgcctcgcccggtgggcgaggcaaaatc

SEQ ID NO: 9 - DNA  (genomic), 124 bp; double-stranded, linear
ttccatgggatggattagcacatttatcttcgttttgcgaattacatgacagtccgaaacaagatgaaaaagtatttaaaaaaggggggaggaagaatgagtaggacgaattattctgaaccag

SEQ ID NO: 10 - DNA  (genomic), 221 bp; double-stranded, linear
agctgcccttttatactcaaacaacaaaaggacagtgcaatgacaacacaatcccaccatgaccacgtagaaaagcagtttagctctcaagccagcgaatatctgaccagtaccgtacatgcatccggacgagatttacagctcctggcggtgtgtctggctgattatcctgatgcaagtgtacttgatatgggctgcggagcagggcatgccagctttgt

SEQ ID NO: 11 - DNA  (genomic), 31960 bp; double-stranded, linear
aatttttccgccggctggaataacaaaaacgagcaataaagaactatcaaatgaccatgttacggaagcgcaactgtttaatttgaaacaaaaaacatatgtatcgatggtgaaagacttggtgagtcgattccagtaatcgttattgttatgctgccgcctgtagtttagggtggcagcaaacaggagttgagtatttctataatgtaaatatgattgtttttataaagttataatatatattaccagtgtattgcatgtgagttatttttttaattcttcataaattaaaatagtatcatctgcaatggaaagaattgctattatctcttcatttttttatatttttcttttaatgtcttgtttctttcttttaatggagtacattcattaataatatcattcttagctgtcattgagtcagtttcgatatcgaatgctaaatctacaaagcaataatctacgtagaacataaatctacgtatatcttccggtatagcagtggaaaaataacggtattgcgtgtaagtggtttgatcatcgaattcgtctgattgtactgaatatgtaaatgtggccagtataaatagtaatgttaatcttaaatttataataatcatttgctggatatctcatctggattttgaaagtcagaaatgtaagcattgtttagttgcatggctcttattttgtttaactcagtatagcatggatatagccgagagaatgccagtcgccctactctggccccccaggttagagtaaaagagcattgagcaaatctgtaacgtataaattccctattagaagactctagtctttttaaagaaataactgcttcttttcttattgcttcgtcctcatcactattccatttttgaattttctcttttatatttgcttctgcttttttaagtgtaatagtgctcataataaatgagtttttaacacaatcaataaattcaagttcatcaacaccactacattctttagacatggaaatgtcaaatgccagaccttttgtacatgagaatgtcagcagtakaataattgttatttttcgcattctcataatactctgtttyttgtgagtaatgtawaaacgaactgaagttttattgcatacttgggatcgccaccaccattataattcatcgctacattttttattgtgataggtttccatccagtaattattactttcatggatgctttttgataatataaaatatctcccgggtgtattttatcgagattttttccaggattgtttttcgttaagttaggtatggtcgtttttctctcttttctgatgttgtcagccaaatcgcctttttggacaatggcgctatatagagttgagtcatattgatcgatagttgattcttcctttgtattagaaagtttcatcattaagtaagtaattgctgctttgatattctcttctggagagccagttatttgttcttttgcccagtaatttctttctggatcttttaacccattgaatgctttgtttctccattgtggtggggtaacaagggctgtagatttttctccagagattaaagctggcatcgctttatctttccgaaaacgaccaatttgtaatggataaccattccactgagaagtattttccgcatcgttttcagtccagagcatggcttttattatataccaatccaacggctgaaagtatggagtgctggacaaatgaatgttgatttcattaacagatttttaaattaataagtcatatttattccattctttatgattgctcacaaatgccaactctcttatttttttccatttaaaaaaatcactttcatcttctgttattcttgatgcgaaatcttgtcttagttgaaatgggaatttttcattaaataacgtactgtcagtgcttgtatttttgctttcactgtctgatgttgaagagtgtaaaatattgttagccattataataatcccatatgtttttaaaaaagacgatcttcccataaactgtatgcactagtgccagcggaacaatgctcccatataattgactcataactgaaagaaactgactcttcgggttgaacgctgttatcaacaacaatatgtgatatagagacatgaatgtcgcttatctttgctccagttaatttgattttatagaacagttcattaattccaaatttatttgtacgataaaaggaaaaatcacatgtcaataattcattgtcgcaaattgctttgcctaataagggtgatgctttatctataggtttttttattgtcaaatgatgatggttgacgttttgatctcgatttaatccatgcatgaattcataaatcataatttgatcaatgtgtgctgtttgagctttatttccaatggatggttgtgatgaacaaccacttgaaatgagcccttgattatcaccatttagtgttaaataaattaaattcgccatttaaaactcctttgtattcatgaatgttattgaaattcaatgctttttttatcgtcggtatcgtattattcttcagcagcagccagcggcttaacacgccttcgagtcgctcattaatttgtttttccagcgcatctgtattctgcttctgcgcacgggcatcctggtactgcgtcaacagagactcaacgggtgtttcctgccccagtccccgctccgcctgccagatgacatttttgatataggaaagggttagtccctctttctcgcgctgcatcactagatctgcaaaagcatgtaagtcctggcgggtctgcaaccagccacgcaactgcgggctactctgtgcgcgggttttgagtgcctcattccattgtgtcgaggcctgttgctgttgcaggctttccggccagcgactgtcggcaacacgcatcatctgcatcccggtttccagcggctgtaccggggaggtatcaagaagttgttgcagcctgcgctcatagttttcgagttcaggtgaggccatccacaccgttgctgcgccctgagcggtgtcgttaacctgtaacagttgctgctgcaccggatagacctgccaccaccacaatgctgaggcgacagccactgaacaggcgatccctgcgataaaccctcttaccgtactgccttgctttatcacactggcctgtgggggattctctgtcagactgcgcacttccactttcatctcaggcaggccgggcaggggaggcactaccgcttctggtgtggaagatgcctgtgtttccggggcataaatcagcgttctgaccgtggtctgtgcggcgttctcagtgttactcttcagctggggttcaagccgtttacgcgtgttctgcataaaatagagcagattctccacgcgcggaacgcgcttcagttccacctgctggagcttatcgcagataagctgcaatgcccgctctgtgcggtagatcagtggtaggtcggattccgcaaaggagatttgctgacgcagaatattgccggttcgggagttaaaccagtccagcatttcagtacgcgccgggccgccctgcggccagaacttatcccagtcgtggcttaccattgccgccagcagttccgcaccttcgcagaatcccgccagtccctgtgtccgtgtccgggcaagcgtatagtaggtggcggtgtgtaaatccacaccgttggctttaaaaatcgccagcgccagcgactccaccagtttccagttcagctcaggctgtgacgggtggctggctttgtttatttcctcgcggatggcgctgaattccggcagcccgcgcgggtcactgccggtaacgatagtttgtgtcagtacgttactattcatccctgcctcctcagtacagtgtgtctgacagaccaaactggctgaacaacccaccgctgaacgggttatcttccgtgtcggtatgcacacggtaggtcatcgcgccaccgtccacgctaaagcgcacggtaaagttgccatcctgtactccggtcagttgtccggccccgaacaggcggaactgcgcccacggcccgctgaagctgatactgcgcggcgcgttgccgctggtgccgatgagcgtcagcttactttcgttgccttcgcgcatgttgttaggccagaccagatgggcggtatagttacggccctggctgtaatcgactaactgaccgtcaaggttcagtacactgcggcgtttattgcctgaaagcgataccgtttccacggcaaaggatgttcccagaccgttctgtttgctgaagaagatgtcacggattttctgcgcagtttccagttgcgcaataatatcttcgcgaataatgacgttgttatcgccatcctccagactcaggtcattatcgataaacagcttcaggttctgctggtagaaggtatccagtatgccatccggtttaaagaagcgttcgaaggcatccagtgaggcatcctgtgcagaacgcggattaaacggatagttatttgccagttgctcgttaaacggtttcaccacgctgtcgcgccagtccacttccatataatgtacagcctccaccatcaccacatgccaggcctggtcagtcagtctgccaacccagcggttgagcggagcaggcagcgtttttgccatctggcgggtggcgaatatcggatcgctgctgttctgatcaagccgtaactgcacggctttcagcgccgatttccctggtacaggcgcgttctggattgccagcaggtagcggtgcaactcggtgagttgctgatacacggcctgcatcgtgctttctttgtctttctgtactgccagggtaatgttttccggggcgaactcatgcccgagacgggtgagtaactggtagtccggctctgccagggcctcatcccgttctttggcagagagtttttcagaaaagacgcctggctgtgtgttgtcacgcagcacggtcagcgcccgctgcaaaggctggtcgccgctgataacctgctccagcgccccggtcagttgtccgatggactcaaaattgcggatattcagattgtccatcccggcccgccaggtggcggtgtagtcgctgatatactgctcggtgagctggcgctggatttccgcgcggtcggcgtcactgtatttcacgctgcgggtaaggttaagtacccaggaatccatcgccgtcagttcaaccagttcatcgcgctgttttacaaaatagctttgcaggccgtaacgggtaagaaactgtggaacaaccagtttgttgtcatcggcagatgtaaacacctggtcaaaggttggccctacctggtcacgcagattgaggtcggcaggaagaacgcccagcgcccgcgttttcaggctctggtaaacccgctggtagacaggcagtttgctcagttctttctgtgctgataccacgggcttgtcatatggcgtccagcggctgatggcgtcaccgtcgcccgcctgacgctctgcgtgccagtcagtatgagccagcgcgtagtcaagatgggacatcagttgtgcctggatatcgcgctggccgtggaacttttcgctccagcgttttgccatatactgcttcaccacctcattgttacgtccgcttttgtcctccagcattcgcatcacgcgcagcaccgcgagtttttcttcactctccggcggcgcggcattcatcgctttaaccagcccgttaaacagcgagggcaggtaacgttgctccagcagttgcagataggtctgttccacataaggtccgatacgtcgtccctggtacagtcccatatcggccagacggctgcggtcgccccagtcgccataggccagtgtggcatcgcgtaccgggttcagcagcggcagttgcaggttgccgtagtcatcttccccctgtggaggcggcacatccataaaggctttggcctgcttaagcacggtgatgccggactgatagttaccgttgtaatagtgatgccagccggtgatgagcagcagtgccgccacgccgccggtggcagagaaaaccgtcaggcggcgacgggaacgcatcagccaggcgcggctctccgttgccagattaggctctgcgagtaatgcctgcgggaacaagctgcgggtgaaataaggcgcggtgtccaccagaggccaggacgccagtgggttattgcccagtcggtactggcgggcggcagactgggtgaatatatcatccatctgcccgcgctgaagcgaagaggtgagatagacaccacgcagcatcacgttcatattttcaccgtcaagcagaccctcaagcagtgacaccagcggttcacggcttccctgcatctggcgggaaaaactgaataaagacgcgcgggtgtgagtctgggtgaccatcagatccggcaacgccagattcattcgatccacccatgtctgccagaaagcattcaactctgttcgccagtcatcattttcatgggcacggcgggtgaacgtgacgcccagaatcgcatcgcgatcctgtctgttcagggactggaacagggcggcaaaaccctgtaataaatcaagccgggtcagtaccacgtaaaccggtaactggcagtgaagatgctggcgtatatcctgtaagcggctgcgcagcgtctgtaacagatgctcgcggtggcgtttgtctgcggtcagcagatcgggtaaatcgagtgtcagaataatcccgttcagcggctggcgcgcgcgcttttctttcagccagccgagggcatgttcccacagacggcgatgcaggatatccgcatcagcgggagcgcagagtgtgccgtcgatatcaaagatcaccgcctgtttaccgacatggggcgtaaggtacaggcgttgttctgtgccgcgcgcgccctccggggcataaataatgtctgacggaaacccctcgcgcagcagtgtcgttttgccactgcccgccgggccgatgaccatataccacggtaactgccacaggaaacggcggttgtcgagatggcgttgcaggcgcagcagccagcggtcaaggtaacgctgctgggcgttcagctccacactgagcggatcaatggcctcttcgcgctgctgtttttgctgtttttcaagcagttgcaggcgcttcattacccggacggtaagccacaccagggcaataatcccccacgccgccgttgccagccagcggttcgccagtggtttgagccactgttcttcatacagcgtccacgtcgggcctttccaccagatccataccagcagaaaaatccacgccagtatcagcaagcagaaaaatccacgccagtatcagcagccagaaagcggagactttaaaccggggcatcgccggtcgcagggctgatttgagtccgctgagtagtcggggtgttggtaatctgaacacaaaaactcctgttctcttttattgttctgccgtgaatttttgttcaagctgcgtaagtaatgatggctcccagtcagacaccatcatctgactccctatcatcaacaacatccggtactgttgctgcgcaagctgtatcagccccgcctcctccgtcaactgtgcggcaaggtactggcggtgaaactgatcgcggggatcgccttcgggtagcatgtccagatatcgcagcgccgcctccagaccctgcccagcaaaacaggctctggctgcctgcgattcctcaccgatttgcgcaaccggtgcaactttgccgtcgggcgaagcagccagccattgtttcgtctgctcactgagaaacggtgtgcggtcattaaacagcagcccggtaagctggggcagacgctcaaggaagcggatgacctcatcgcggatggtgtctgccacctgtttgtaacccagacgcagtgccgtctgtgcagaaagacagtgaccgtccagccagtaaggagccagcaatacgcttttctcaacctgttgccacagcgccatatccgcgctggcaagccgggactggtaatccgccaccatatcggcagagaccgcagccagtggggtacgtccatcgctttccgcctggggtgtactggtgatggattgccacagggcatggcggcgcaggcgatagccctgcggcgagtccggctggcgttcacataaaatagccgccacttttaacagcgtgtcgcgccaggctttgtcgtcgtgactgtcgatggcgatttggggagccggagcactgggttgcgtcacgccgctttcagacgtgacggtggtttgtggtgaactaccggaggccgccggagtggggaccggagcaggagccgcacgattaaacgtacgctggtacagggcaaaaagatcatcggtagcctgtgccagttccgggacgttatgtgactgccagcactgcgccagtttcgccagctcacccagcagagtatcgcgctgcgttgtggcagcgttttgtgaaaagccttcaataccgtttcaaaacgtttaatgatctggctggcaaagcgttttttatgcgccatattctgcggcgcggccacagtccagtaatgttccacgtatagcgttagcaggtgcagtgccagcagtggatcaccggcatgttgcagggttctgagcaggtgtgccagtagcctgaagtctttgctttcagaagccagaagctgtagccccctgcgttgtagttcgggaatatcaagctgagcgtgggccagagaccccagcttgacgatttcgccgtcgatatactcccagtccgggttgtcatctttcagcgccgatgccagtttttcttccggcaggttttccagcaggtgcgatatccagacattcggatcgcgtaagtccattgccatatttttattctcccgcccagtggcaggcatcgcgcaggggggcaatcgcccttgccagcccgtcaatgttaaaggtcagctttcctgcggcgttatctgcgccggtatccactgtcagcgtttttgcgccgaacagttgcttaatttcatcaatcccggacagcccccggctggactccagcagggtgccgttctcgcgcacaaaccagtggctgcgcaatgcccggctgtcggcattcagagtgacggcgatatcatggacatccagagggtgcatcagcgccacctgcatccgggtgatattgtccacgcaactgaacatcagcaccgggcgcggcggaacatggccgatagccggggtggttatcaccaccgtcgggcgctcccccggcacctgcgtcaccagcagttctgtggtgttgccctcgcggcgtttttcctgctctgtggcgcgggtccaggcctcgcccacaaaaccggctttgaccagcgccccgtcaaaccctgacggggacagcggtgccagcaggtggtcatagcagtcaagccgctccagcgccgcggactcccgccgacaggactgcatggcctgtaacgtggctgtcgcatccggcggggtcgtggtggcgacggcgaccgccacaccggccattgacgatgcttctgcgggcgcggcagtggcgggtaagcccgtcatcaggcccgcgataaaccatcctgtctgccggaaaacgcgcaacctgctcataaaaccgtttcatcctttgtgacggactcgtcgttctgagcatcttccacgtctgccgtaaatgcgccgtccactgccgacaaccgaatccgggcaatcgccgtgttagccgccattttctgcaacagcagcagcgagagcggcggtagcatgtcgccatcgatgacagattccagcatcctcgcgccgttttccgcgcgggtgacgcggctcatgatttcgtccgtcacttccggttcaatgaccacttctgcaccaaagcgactgcgcagcacgttatccagacgggccagtttcccggcgataatggtggcgagcgtctctttcgacagcggcaggtacggcaccacctccattcgcgccagcagggcaggtttaaagaagtccgccagcaccggatagagggcttcctgcatggtttccgggtcatccgcgtgttcgacaatcacctggtaaccgaggttggaggtgaggaagaagacgatgtttttacagtcaatcaggcggccttcgccgtcggccatctcgcccttgtcaaacgcctggtagaacaggttgaggacatccgggtgcgctttttccacttcatcgagcagcaccaccgagtagggtttctggcggatggcttcagtcagcacgccgccttcgccatagccgacatagcccggaggggagccaatcagccgcgaaacggtgtgtttctcctggaactcggacatattgatggtggtcaggtactggcgaccgccgtagagcagctctgccagttgcaggacggtttcggttttacccacgccgctggggccagcgagcaggaacgcaccgagcgggcgtcccggacgacgcaggtcggcgcgtgcggtcagtagatgcttatgcaggctggcaatcgccaggtcctggcctttgatggtgtcgcccagccatttcggcaggtcggtgatgaccgacatttcattctgcgacaggcggttgagcggcacgccggtccattcggcaatcaccgccgcaatctgttttttatcgacgtgcggggagaccagcaaccggtcgttatgcagggcgtccagttcggcagtgagctgggccagccgctgtaccggggaaactgtttcagcggtctcttccggctgttctctgtcggtctcatcagccggtacggcaccggtattatcctgttctgactctgactctgactctggctgcgtatcctccacagtatctgcgtccggcaacggcgccgcatcgtcctctgccacgcccagtaactgctggcgcagcgcgataatctcccggaccagcgtctgctgctggtgccaagccgcttccagttcatccagcgccgtcagcgtttcatcatactgcaccagcacctcggtcatccgtgatgtgtcggtacgcagtccgatgcgaagctcgcgctcaagctggcgaatttccgcctcctgctggtggctcagagtggtcagcgccgagatttgcttcggcggcgacgacaggttgatggccacacgggcgcaggcggtatccagcacatcaatcgctttgtccggtaactgacgcccggagagataacgttcgctcagcgttgctgcggcctgcaaggcatcatcgtcaatcagcacgccgtgagaccgttcatagaccgccgacagaccacgcagaataatggtggcttcggcagcgttgggttcgctgaccttcactaactggaagcggcgcgacagggcggcgtctttctcgaagtattttttgtactcgctccaggtggtggcggcgatggttttcagttcgccacgcgccagcgccggtttcagcaggttggagatatccagcccgccctgctggttgcccgcgccaatcagggtatgcgcttcgtcgataaacagaatgaccggcaccggagaggaaatgacctccgccatcagccccttgaagcgtttttcaaactcacccttcaccgatgccccggcctgcaatgcgcccaggtcaagggtcatgatatcggtgtttttcagtttgtccggcacctggcctgccacgatgcgcagcgccagcccttcaatcagcgcgcttttacccacgcctgcttcgcccaccaccaccgggttgtttttacggcggcggcagagaatgtcgatcatcaggtcgatttcgtggtcgcggcacagtactggggctagcctgccgttacgggcgtcttctgtcatgtttttggcgtagcgggcaagcagggtgtcagaggcgtccgtcagtgtgcctgcgcctttaccgtctgcatccggcacgactgattccgccgactcctgtgtccactgcacaaagtcctgttgcagacggtcacggttaatgccggtcaacagccgggcggcagcaggcggtatataacgcagcggcgaatgcagcaaggccagcagcaacacgccgccgcgcagttcgctgtgctgcatctcagccgacgccagcagccagccctctttaagccactcaaccagcatcggggaaaacgccgggtagctgtccgcagaacgggcggttgtgtagttctctaccgtcaacgcctggcgcaactcttccatgccaatatcgccctggcgggtaataacccgcaggtcactgcgtggcatggcgagcatctgaataagcacatggctgacggtaatttccgctgcctgctggctcatacattctgaggcggccatctccagcgcctggcgggagaacaggttcagccgttttaccagcgtgggaagatcaatctggatcataaacgtccttatcgaagtaatttgtttagctggtgcaggatgtcctgcgtctggctgtccagccgcaacagatagaacaggtaaaacaacgccagcacgacaacgccaccacaaaaaatatgtttaacagtcaggcgactgatgagctgataacgcccgccttgggtttttttgtcctggtgtaacagcgggaaaggggcatcgccgcgcagtttatgcagaacgtggtacagacggcggtagatctgctcaaattccccctgatcctgtactgccactttgtagcgcccgcgaaatcccagagaaaaacagagccagagaaattccagcagatcctggtaacgtttgggttcacggatcaggcgctccagcaggatgaaaactttctcgccaccccaggcttcgttgtggaaatggaccagcaatgactgcttgatccactcgttcttgttcgaccagccgttaccgagcgccgcttcatcaataaacgtgcagaggatgtagcgaaacgagataatcacgcccggttcgtagccctgttcctgaagcagttgctccacggcctgaacatctgtcaccacctgagcaaaaagatgctccggcatcgtctggctgttcatggtggaaaggcgcattaccataccgagtagcggcgtcgccgcgtcgatcatcggattcaggctgttgccatgaagcgcgagatggtagtcgcgcaggcttttttcgtcgtatccggtaaatggtggcagagacagtgacccctcatccatcgtcttaccctcttatcgcccacagttgcatgttcagatccgggaaactgccggatacatgcagtgcaacggccccggcggcagccatttctgtccaggcctggccgctcttgtcgagttcgaaatagctgaacccggaatggtagggaagctggcggggggccaccatcagtgcgcgcagaggaatacccgggatctgcacactgaccatattgcggattttttccggcgaggaaattttcgactgctggataaactgacgctggatctgatcgacaggcatatttgctgccacggccagtacaaaggtggcagactgtagcagttccgagtcatgaacatcggcctgccagatgccgtcacgcagatgcagcggcagattgaccgctcttggcgacagtacggtatgcagcgcccgtttgacttccggtaacagtgttttaaatgttttggtcaggtcatgatgatcatacacatcaagcgggcagggcaggcgtgacggctctgtaaaggtcatcagttcacccagcaactcggcaagatcaaggtagaaatcttccgggtggagctgggatcggcgggcgcgatgggtaaaccgggtctggttacggttaagcaactgcaacatcataaattccgccacatccgcgatgccgctctgcgccggagagccaatacggtttgccagatcgcttgcccgtccgccaatggccccctgtacctctttgagataaacacgcagtttcttactgacctgaatattctggcaggaggggataaaatcgtcatccagcgtcagggagccgtcggcatggcgatcgctgatacggcaaagcgggagcgtaatataggcactcatatcttctgcaccgctcataatgcgcggcgtcagttgtcccagcgtcagtgttcgcgcgtcgccttcttctgaatgcagatcccggacatcggcataattcagccggtaacgcccgattcgccgcccgtcgctgatttcatttctcacatcactggcgaccggcagagcgaggtaaatattgcggcttctttcgtccggaaaattttgcgggtgcagcggatcgggcagtgcgtcctggtcggggatagaaaagacggtgccgtcaggcagtgtgcctgacgcgctgtcaatcatgatcttaccctgcgccagcagttcattgttgagggtgagttcggtaaatccccaggataaatcattcatggcccggaaacgctggttatccaggtagtcgttgtaacgctgctgttgctggaaatggtgtgggcgcatcagcatcccttcctgccacatcaccttgttgcgggtggttgccataattattcatcctcttttttcatttcgatgctgctttgacgtacatgcaccagcaggcggtaatggtggccggttccttccaccgtctcgatttgtttccattcagtggcctggtcatcggagaaataggccacgacaccaataaactgcgttttctcatccagctttatcggcggcagggttttgatggtgtccggcaacaggttgaaatcctggtggtcgatatagtttttacccagcacatccggtagcggcgtactggctatctggtcatagtcggctgcctgcaattttgagtcgtcagtcaggtacaccagttgcacatccacggcggctgattcaccctccgcattggtattggtgtccggttcagtcagcagggtgacggttatttccgaaggttgctccttcaggctcccgacctggatatccgggtttttgatcacctcgctgatttttttcgccgtttcgcagccggttaatatgacgcacatcagcacgcaggccagaaacgccttcctgttcatgcttccggctcccgctgtttttcacgaagcacccggtcatagacctgggcgtagacctcgttaaacagcatctcaaacccctgctggcgatcggaggccagttcttcgtaataatggctgtacatttgccatgctccggcatcatccagcggctggcgcagttcatggctgcggcggtactgcacaaagcggcgcagcagattttgtggtgagaaagcatccagcaggacacgaagcgactccacaatcgccgcccggttagcttcttcgtggtggcggacattgcgcaggctttcactgacggcggcgggagccgccagatgtaccgggcttttaccttcggcaaacatcacgtcgagcgcggtggcgtaatccatgttcaggcgcagcgggttatcttccagcgggcgcaaatgtttgtctgagaggctgttacgctgctgctgcaaatcgagcagaccttttattgcggcctgtaacgttcgtccggcctcctccagaaaatcatccgcatcgtcggaattgctcacggtaagcgagccgccaagaccgcgcagtaagggggtgaccgcaaggtggcgttgcgccatttctgccgcagagatgtcatcattatgatcgccagggctggcataaatgggcggcagatccataaacggagtattgatccccccattacttgccggatcggacagcggtgccgatggccggacagccgcaatgcctgaaagcggatcgcccgtggtaatcaggctttcggactgaagtgcctggagtggatcggcagaaaaaccatttaccacggtgtctgcaagctggtgccggtgagtcattcccggatagtgtggcgcaccctccgttgatagcagggtatccgtgagcatatcgcgattggtaacgatggtttcgggagtggccatttcctcatcgtaatggggaatatctccccggttcagatgaaccctcaccatcagccgtccgatctggatctcatcgccctggcgcaactgtatcaggtctgatgttgctgtgacttttgcctgattcagccacagttgtgccgtctgcgggcgtagacaaaatgtgccatcgtgcaggataacggtaaaagcctgggccggaatgctctgctgacgatcctgtaccgaccagtggcattcgggggcatggccgacatttccctgctgtgtgaacagacagcgcgccgcccgcccgctttccagctcactgccgttaatgacctgcaatgaaagcgtctgtagtttctcttccggcatattctgctccgtgattatcataatttacgaccgtaccctgatggtgactgagggtcgttcttccggtgtgccgaggaagctggtccagcccagcagcgcacttttgttatcgcccaggcgcattgcgcccacctgctccggcgccagccccagatgtaagtcccaggcaagctgatcgcgcaggatgaaggacacgaacgtcgtcagtggcaggaagttttcgccggacggcagaaaagagaggaactgttttcgggtcaggctggtaatactgagctggaattttccgctgagatcgggtactcgtgtacccagaacaaagttgcccagtaccgatcttcccgccagtttttcgccatttttaagagaatagctccccaggctgttttgctgatccggttcaatatccaccttgcgacgttgccagttttgcagcgtcacttctgacaaatcaaagcagtgggacaccaggccacagataatttccggggatcgtcccggatttgccaggatcccggaatacgccagcattttgctgtgattaatcgccagcttatcgcgaagctggcggtggcccagcccgacaagggagtacatgcgctgcgagaacgcatccacaccgccgttacgaaaactgatgtgatagcggtacttacgccagatatgccagacaaactgggtcaggcggtggctgaacatatccagaaaatcacctaccggactttgttcatgtaccgctttccaggccaggtgatcgaggtaataaccggggagaggcgactggctcccctgtaaccccataaaggtagtggtcatcctgaatgcccctgacgtatcccgtttcagcgcactgatatcactgcacgggaaggcaaggctggcatcggcgctgaaacgcagggtttcctgtgccggatcgtcgcgcagggataattctggcgtccccttttcaccctttgccaggcggtgcaacagctccgccatcgcaaaaaaattgtaagagcaggcattatggaaaacctgtgccagcggatcattctgctctttatctgccgggggatttcccggactcagataagaggatgctgcccgattctttccgtccatttccatgtctcctggctttctgtgttcacaacggtcagcatgtggaatgagttaacgctggcgtacagcgacagaaaatgcgaaagcaccgtaccgagcagatacatttccccttcacagacaaacggctccgggtgcagatacagcgtggaggccagtccccggacgggaatacccgtaaacaggcgatcaacggggcgggtctccagacgctcaatggcatccagcttttgttgtgacagccgcgccgtctgcggatggtggattgcgtggcgatcaaagttggcgatgacctgcttcagcgcgtccgtatccagtaatgacagataattcaggttcatggcggagagcagggaccagtgcaggctgccatcaatgaccggccagagtggttgcgtcgggcgggtaatgttgcgaaaggaagcaacagccgcatttttaccggttgtgccggtgatatcgccggaacgaatttgtgacggaagctcacggttggtacaggtcagcgataccgaaaccacttcattactgagcagagattcgtctgacggataactgccatcagcatgtataaaggcaagggtatgatcaaagccgcgatggaacagggatgttttggtccggtgatgccagtacaccacctcccgcttccggctgtattccatctgatggctgaaactttcaaaggctggccactggcgcgcggcctgcgtcgaaacaggacgccccagatcttttttcctgaacatatcctggacctggctcaccacactgttaacggaaaatacatcgtaatgttgtgggtaatggcggctgggaaccagcggatagtctgcccgccggttgtccagcgtgatggcttctgcatggtggataaataaattaatggcaggtgcgcaatacaggcgcagggaatcgcggcgcagccggatgtccacgggcaaagggcgcgaaaaacgcagttgcagggtaaagaattccgcctgcaatccgtcaggcaaagccggacaaccacaaagatcaaaaaagagaaacgcatcggggtaacagaaatactcctgaaggatccggtagccgctgtggacgtttttcggccagggcagcatggcatcctgcggctcaaaaccgacagcttttagcataaactcaggcaggcgaatatgctgttcacccacagtcaggtcggcaccctgcaagtattcgcagaaccataaataaagctggtcacgggtatagttgtcgtcattgccgagccagaagcgaagtttgttcagatccagcgtgcggaagtccgttcccggtgcgaccgaaaaggtgatgttgataacaccattacgggtcgtactgcggttttcaatctgctccaggcgaacgggcagcagccagatatcccggcagagggtgaaggtacagggaggcggctcctcctttttagcatcagagggcagcacttcatcaactctgatttccccggcgttggttgtaaactgctcattacgggggattaacaccggtacagaagacttatccatatccggcgtatattcaataagggtcattgccggaaccggacgcaggtaattaggccatagcatcttaataagcccgtgcgtcagttctgggaattcatcctcaattttctggcggagattgccggtaagaaaagccaccccttccagcaggcgttcaatatccggatccgcatctttttcggccaggaagcgggccagatggggtttttccgttgccagcarcttgctaagctggcgcaggtaatcgagttcttcccgaaaatagcgttcttcaaattccatttgtcagtccacccggtaatgctggctgccattcggtgccatatcaaattcaagcacctcatgcgtttcgttaaatgtcacccaggctgtaatatgaaacgtcatatccagcgggctggaggcggatgaaaccactgcctgcacttcagcgtgtgagatccggggttcatagcgttctatacattgctcgatggcccgactcatggattcgcggaagttttcagccccttccggttcatcaatgcccagctcaggcgcaccccggcaactaccggaccgggtattaagaatgtttcttaggttctggcgaatggattgcctgagcgaatgaatactgcctccctgccggtttctggccgaagaggcttccatacgctcaaaaagagaacctgtggttctttcccgatccagtatcatggtgtgttactccctgtctaaccggccaaccagggaaagctcaaaatttgcccccataaatttaaaatgaggtctcacgcttagcgcaacctagtaccagccgggttcgccttctacatccataacctcaactttggcagcgcgcagaggtttgcggctgcgcacgtctgcaggcgggttttcctggtcggcaacatactgacggatccaggtattaagctctctttctaagtcgctcctttctttccatgaccccagttgttcacgctgcaacaccttgatgtagtgcgctaaccgattgatgatgaagagataaggaagctgcgtacccagcttatagttggtttctgcatcttttcccggaaagtgcttcggtttttgtaccgagtttgcagagaaaaaggctgcattatcagagtctttacgcatggtaagggtgataaaaccctcttcagccagttcaaattcgcggcgatcggtgaccagcacctcggttgggattttggcctgaatctgccccatcgtttcgaacagatgcaccggcagatctttcactgcgccgccgctttgcggaccgataatgtttggacaccagcggtatttggcaaaactgtctgcgatattgcatgccagcatccaggccgtattaccccacagataatcttcgtggttctggctgacatcttcgtaatagttaaagttcttaacagggttatctgttggtgaatagggctggcgaagcaggaagcggggtgccgtaagccctaaatagcgcgaatcttccgagtcacgcagggcgcgccatttggtgtaggccggaccttcaaagatggcataaagatctttgatattaggcagttcggtccacgagttcagccccataaactccggggaaacggaggacaggaacggtgcgtgcgccattgcgcccacggcactgacgtattgcagcagtttcatgtcaggcgcggtatttttgaactcataagcgcccagcacggcagcgatgggttcaccgccaaactgtccgaaaccggacgaataaacgtgcttataaaatccggactgaataatttctggcgcaaactcaaagtcttccagaagttcctgcttggtgacatgaagcacgttgaccttgatgttttcacggaaatcaacgcgatccaccatggttttcagtgagcgccagaacgactcgacctgctgaaaggcaggcgcatggatgatgacatccatctggcggctgatgcgttcatcaatatctgcaatcatgctgtccacggccagtttattgaccggttcggcagatgcagtggattgcaggatgctggcaataaaggctgtcacaccctggcgggcaacgtcataaccttccgaaccgggctgaatacgggtctgtgccatgatttgatcaagcagcgacgattcctgctcaggctgcccggcatgactggaaacgagttcctcttcctgtaaagacatactgaaaatccttctgttttagctgtgtttctgaaaccggcttttcgccgtcagtgaagtacgcgctgccagtgcgacgcgctctgctgaaactcacaaaaatggataatctcatccaatagatcactgatacggcgatccagtgttgtaatcagcgcagccacaccatcctggttgatttcaacggacgggctgaaacatacctggtaaaccacctgcagaatgtctgcaacagagaggtggtatgtcccggagatatttttgtgtgccgtcatgcctggataaccctgtttaatgaaatagtggtggttatttattgctcacctggccgatttctttgagcaactgctcgcgggactcttcattttccagcaatgcctggagctgggtacggaatgccggaaggttacccatcggccccttcagtgcagtcagtgcttcacgcagttccagcaatttattcacttccggaacctgccgggccacgctatctggtgaaaaatcatccagtgacttgatattcagcgccacattcatttcatcgtccgttgtgcttcccttcagcgtggcggggacggtaaaattgaggccaatggctgcttcagccatcactgcaccgaaattgtgcttgttaacggaaactgcctgacgttcatccagtgaggatgtttcctgcgtatttccggtatcgccgacaacgagcatgttaagcggaagttccacttcagccgtctggccatctgtttttgggacatacgatatattaatacgttcgcgaggcgcgacgctgccttcaaattttttgctcataaaagtgatccgtcatgttatctcgtacaggccatgaacacggcatattcgtaccgcaaaaaatatcggaaatgccgtcttgatggcggtgaaaataaaatcaccactccttcatcaccccgcattttacgcttcaaaataaataagaaaaggactttttatcgatcgtaaagaggggtattctgcaagcgttaaatagattttatgaacctgtgcaattcgcgtcaggtgtattgtggcaataatttaaatatagagttttttgtgtatcttattgaattatataataattttattaaacataagctaatctaatgattgcttgtttatatatttgttttgtgattgattaagtgggtatttttaaggaatatctcaaaaattatcaaaatgataattcagaaaggataaatacaatatttattcatgattcagctttggccattttatggaggcaatacggactttgaacagttgggtatggctatccagatatatattattaagttattgctgaataagagatttaatgattttaaaaatagtttttacgacaaccgtaaattctagctcggtttgtatgtaaaaaatactgaaaaatgatgcggttccgtgaagtgagctgcatctgcctgtctgggattaacggcaggtcattgtaagtagtaattaaccacgttaacaaggagtttacaaatgccaacaccgtgttatatctccatcactggtcagacccagggaaatattactgcaggtgcatttaccgctgattctgtcggcaacatctatgtgcaggggcacgaagacgagatgctggtgcaggaattcctgcataacgttactgtcccgaccgatcctcagtccggtcagcctgcgggtcagcgtgctcacaagcctttcatttttaccgtggcgctgaacaaagcggttccgctgatgtacaacgcactggcctccggcgaaatgctgccaaccactgaacttcactggtggcgtacctctgtggaaggcaaacaggagcattatttcactacccgcctgactgattcgacgattgtcgatatgaaactgcatatgccgcattgccaggacccggcgaaacgcgagttcacccagttgctcgaagtttcactggcctaccgcaaaattgaatgggaacacgtcaaatctggcacctccggtgccgacgactggcgcgcaccgctggaagcataagttaagccaacagcatccggctatcaggccggatgctgtttttgtattacgccgtagaaagaaaggttgtcagtaaggggttacgttcacgggagatggcggctgccggaaacttcggcggtagcgtgcctgaacgcaagcgtagcactgtactgtcacagccgctttaacagcgaactgtctgtttttccttaaccccggaggttgctatgtcaaccggattacgtttcacgctggaagtggacggcctgccaccggatgcttttgcggtggtctcctttcatctgaaccagtcactctcttcgcttttttccctcgctctctctctggtcagccagcagtttctctcccttgaattccagcagatcctcgacaaaatggcctacctgacgatatggcagggcgatgacgtacagcgccgggtgaaaggtgtggtgacctggtttgaactgggggagaacgacaaaaaccagaagctgtacagcatgaaggtgtgcccgccgctgtggcgcacagggctgcgccagaacttccgtatcttccagaatgaggacatcgcaagcatcctcggcacgatattgcaggaaaacggggtgaccgagtggagcccgctgttcagcgagccacatccttcccgtgagttttgtgtccagtacggtgagactgattacgatttcctgtgccggatggcggcggaggaaggcatcttcttttatgaggagcacgcgcaaaaaagtaccgaccagagcctggtcctgtgcgataccgtgctttatctgccggagtcctttgagatcccctggaatccgaacacccgtaccgaggtaagcaccctctgcatcagccagtttcgctacagcgcacaaatccgcccttcttccgtggtgaccaaagactacacctttaaacgccccggctgggccggacgttttgaccaggaaggccagcaccaggattaccagcgcacacagtatgaagtgtatgactatcccggacgtttcaagggcgcccacgggcagaactttgcccgctggcagatggacggctggcgaaacaacgcagaagtggcgcgcggaacaagccgttcgccggagatatggccgggacggcgaattgtgctgacggggcatccgcaggcgaacctgaaccgggaatggcaggtggtggcaagtgaactgcacggtgagcagccgcaggcggtgccgggacgcaggggttcaggcaccacgctggataaccattttgcggtaataccggcagacagaacatggcgaccacagccgttgctgaaaccgctggtggacggcccgcagagcgccgtcgtgacgggaccggcaggcgaggaaatcttctgtgatgaacatggccgcgtgcgggtgaaatttaactgggaccgctataacccgtcaaaccaggacagttcatgctggatccgtgtggcacaggcgtgggcaggcaccgggtttggtaacctggcgataccgcgtgtgggtcaggaggtcattgtggacttcctcaacggcgatccggaccagccgatcattatggggcgtacctaccaccaggaaaaccgcacacccggtagcctgccggggacgaagacgcagatgaccattcgttcgaaaacctataagggcagcgggtttaatgaactgaagtttgacgatgcgacagggaaagaacaggtctacatccacgcgcagaagaacatgaacaccgaggtgctgaataaccgcaccacggatgtgataaacaaccatgccgaaaaaataggtaacaaccaggcgatcaccgttaccaataaccagatcctgaacattggcgttaatcagatacagacggttggtgtcaaccaggtggaaacggtaggcagtaaccagattatcaaagtgggatcaaaccaggttgaaaaggtggggatcattcgtgcgctgacggtgggtgtggcgtatcagacgacggtaggcggcattatgaatacctcggtggcgttgttgcagtcctcacaggtagggctgcataaatcactgatggtgggaatgggctacagcgtcaatgtagggaataacgtcaccttctcggtgggcaagacgatgaaggaaaacaccggacaaacagcagtttattctgccggtgagcatcttgaactctgctgtggtaaggcaaggctggtgctgacgaaggacggaagcatatttcttaatggtacgcacattcatctggaaggggagtcggatgtgaacggtgatgcgccggtgattaactggaactgtggtgccacacaacctgtaccggatgcgcctgtgccgaaagatttaccccccggaatgccggatatgcggcaattttgagtcaggtgcaaaaaatcaaaacggaactggtgcagtgaccagataaaccatattaaaagcagaaggaattgattcatgggaggaaaaccggcggcgcggcagggtgacatgacccgcaagggactggatattgtgcagggttcagcaggggtgctgataggtgcgccgacgggcgtggcctgctcggtgtgtccgggagggattacctatgctaacccggtgaacccggtgctgggtgcgaaggtgctgccgggcgagacggaccttgcgctgcccggcccgctgccgtttattctttcccgcgcctacagcagctaccggaccagaacacccgcgccggtgggggtgtttggtcccggctggaaagcgcccttcgatatccgcttacagatacgcgatgaaggcctgatactcaacgacaacggcggcaggagcattcactttgagccgctgtttcccggcgagataagctacagccgcagcgagtcgttctggctggcgcggggcggggtggcggagcagcacagttcgcagccgctaagcgcgctctggcaggtgctgccggaagatgttcgcctgagtccgcatatgtacctggcgacaaacagccttcaggggccgtggtggatactcaactggccggagcgggtgccgggggcggacgaggtgctgccgccggagccgcccgcataccgggtgctgacgggcgtggtggatggcttcgggcggacgctggcctttcaccgggcggcggagggtgatgtggcgggcgcggtgacgggggtgacggacggcgcgggccgccgttttcacctggtgctgaccacacaggcacagcgggcggaagtattccgtaaacagcgcgccacgtctttatcttcccctgccggtccccgttctgcttcctcttctctggttttccccgacacgctgcccgccggtacagaatacggtgccgataacggtatccggctggaggcggtatggctgacacacgacccggcatacccggatgaactgcccgccgcgccgctggcgcgctacacgtacacggccagcggagaactgcgggcggtgtatgaccgcagcgggacgcaggtgcgcgggtttgcttatgatgcggagcacgccgggcggatggtggcgcaccattatgcgggtaggccggagagccgctaccggtatgatgataccggccgggtgacggagctggtcaacccggaggggctggactaccgctttgagtacgggcaggaccgtgtgaccatcacggacagcctgaaccggcgggaggtgctgtacacggaaggcgagggtggcctgaaacgtgttgtgaagaaggaacatgcggacgggagcatcacccgcagcgagtatgatgaggcggggaggctgaaggcacagacggatgcggcgggacggcggacggagtacagcctgcatatggcgtcgggtgcggtgacagcggtgacggggccggacggcaggacggtgcggtatggctataacagccagcggcaggtgacgtcagtgacgtacccggacgggctgcgcagcagccgggagtatgatgagaagggaaggctggcggcggagacctcgcgcagcggagagacgacgcggtacagctatgatgacccggcgagtgagctgccgacagggatacaggacgcgacgggcagtacaaaacagatggcatggagccgttacggtcagctgctgacctttacggactgctcggggtacacgacgcggtatgagtatgaccggtacggtcaacaaatcgccgttcaccgggaagaaggcatcagcacttacagcagttataacccgcgtggccaactggtcagtcagaaggatgcgcaggggcgtgaaacccgttatgagtacagcgccgcaggcgacctcaccgctatcgttgccccggacggcagccgcagtgagatacagtatgatgcgtggggaaaggccgtcagcaccacgcagggcggtctgacgcgcagcatggggtatgacgctgccgggcgcatcaccgtgctgaccaacgagaacggcagccagtccacgttccggtatgacccggtggacaggctgactgaacagcgcggttttgatggccggacgcaacgttaccactatgacctgaccggaaaactcacgcagagtgaagacgaggggcttgtcaccctctggcactacgatgcgtcggaccgcatcacgcaccggacggtgaacggcgacccggcagagcagtggcagtatgatgagcacgggtggctaaccaccctcagccataccagtgaaggccaccgggtgtcggtccactacggctatgacgataaaggccgcctgacgggtgaacggcagacggtggagaacccggagacgggggagatgctgtgggagcatgagacggggcacgcgtacagcgaacaggggctggcgacccgtcaggagccggacggtctgccgccggtagagtggctgacgtatggcagcggttatcttgcggggatgaagctgggcggaacgccactggtcgagtacatgcgggaccggctgcaccgtgagacggcccgcagcttcggcggggaggcatatgaacttgccaccgcctggaataccagcggccagctccggagcaggcacctgaaccttccgcagcttgaccgtgactacgactggaacgacaacggacagctaatccgcatcagcggcccgcaggagagccgggagtaccgttacagtgacacgggaaggctgacgggcgtccacaccacggcagcgaacctggatatcgatatcccgtatgcaacggacccggcaggaaaccggctgccggacccggaactgcacccggacagcaccctcacggcatggccggataaccgcatcgcggaagatgcgcactatgtctaccgctacgatgaatacggcaggctggcggagaagacggaccgcatcccggaaggggttatccggatgcacgacgagcgcacccaccactatcactacgacagccagcaccgcctggtgttccacacgcggatacagcacggcgaaccacaggtggagagccggtacctctatgacccgctgggccgccggacgggaaaacgggtgtggcggcgggagcgtgacctgacggggtggatgtcgctgtcgcgtaaaccggaggagacctggtacgggtgggacggtgacaggctgaccactgtacagacccaacagacaagaatccagacggtataccagccgggaagcttcacgccgctcctgagaatcgaaacagagaatggtgaacaggcgaaggcgcggcaccgtagcctggcggaggtgttgcaggaggacacgggtgtgacgctaccggcggagctggcggtgatgctgggaaggctggagcgggagctgcggcagggcagcgtgagtgaagaaagccagcagtggcttgcgcagtgcgggctgacggcggagcagatggccgcgcagctggaggcggaatacatcccggagaggaaacttcatctttaccactgcgaccaccggggactgccgctggcgctcatcagcccggaaggggaaacggcgtggcagggggagtatgacgagtggggaaacctgctgggcgaaaccagcgcgcagcaccttcaacagtcactccgtctgccggggcagcagtatgatgaggagtcggggctgtactacaaccgcaaccggtactatgatccgttgcaggggagatatatcacccaggacccgatagggctggaggggggatggaacctgtatcagtacccactcaatcctattgaacatatagatccgttggggttagcacttgatttgaattattattctccgtcagatcctatatataaaggttctcttaatgtaagggaatttccaacgggttttacagttggaggtcatggttcgcctacatctatgagtgatgacagaatcaaaaaaggaagtgatctgacaataaaacaattagctagcgacataagagcgaatcctaaatatcatgaaggtatgcctgtagtcttgttttcctgcgaaacaggaaaaggcaaaaattcatttgcacagaaactagctaacgaacttgatgctacagtgattgctcctgatgaaataatatggatttggccggatggaaactatgctattatggggcaaacagctaggataacaataggcggtaaggacaacggggtgtttgaattggtgccagacgagaaacaaccaggggactttcataagtttacacctacaggaagcaaatagtaatgaaagtatttacttttttgttgattatcatggtatgtctttataactttggagtgagggctgctatggataactcaaaacattctgatgaggcggaaaaattattggcggagctttctgctagaaaaggtgaaggtgaaggtgaaggtgaaggtgaaggtgaaggtgaaggtgaaggtgaaccaaaatcaacagtaagcgtcttttatttgcagccagaagaagtaaatactttatcacaccaggcaaaacgaggcgatggcgaggcgggttttaggttgttcttgtactacaagttgtccaattatgatgaagaaaaaagtagtcagtggttaaaaatagcggctaataatggtcatgcgacagctcagtatcggttatatgtagagttacaagaacaaggtgaaaccaaggaagctaatgaatggttacaaaaaattaaattggctgccagtaataatgacagttcagcaatatggttcttggtgaattgttataaaaaccagggaaataaaaaagaagcattgcaatgggcatataaactcaaagcgagtaaacagccgcttgatgcagatcgactaattgaagaattaacgaaagaacaaaagtagctttaaacaggtaacagaaaaatggagagtagaaaaactttaccagtcgctacaacacctacacacaaaattacgtttacgacgactgcaacaagctcatcaaagcgcaagttgaaaccaaaactggcatcttcgtcgccggttatcattacgatgtacttggcagatgcatcaaaagtcgcaagagaaaagatgaaaatatagctttttgtatcattaagtatgtggccagcacatgactcggcatagatcttatgactaagattctacaccccaaacctaagtatgggccaaagaagccgtttggttcattttttatatctccagcattttagtggatggagcttatgaaaataataaggttattattgctggcttgttcgataaccattcatttttttattgtaaaagaacatgtatttaaaatattcaatcaacatgcttattgttttttgtttgctttttatgttttgatagtgttctgttttttgttattttttaaaagatcttttattgttgatttaatagcttgtataataattccttatatttcttctgtcataagtttcttgtttttgtccatgttaatatctcctcacctcagggaaagatcacctaacgccgcttttttgtactaaataattcgcactaaatgttcaataattgagatgttccttattatctaaaactgtttttcacagcttacatatgatcaaatactccttgcataaataaggagaacaaaatggaacttaaaaaattgatggaacatatttctattatccccgattacagacaagcctggaaagtagaacataaattgtcagatattctactgttgactatttgtgccgtcatttctggtgcagaaggttgggaagatatagaggattttggtgaaacgcatctcgattttttgaggcaatatggtgattttgaaaatgctattcctgtccacgataccattgccagagttgtatcctgtatcagtcctgcaaaatttcatgagtgctttattaactggatgcgtgactgccattcttcagatgataaagacgtcattgcaattgatggaaaaacgctccggcactcttatgacaagagtcgccgcaggggagcgattcatgtcattagtgcgttctcaacaatgcacagtctggtcatcggacagatcaagacggatgagaaatctaatgagattacagctccccctgaacttcttaacatactggatattaaaggaaaaatcatcacaactgatgcgatggggtgccagaaagatattgcagagaagatacaaaaacagggaggtgattatttattcgcggtaaaaggaaaccaggggcggctaaataaagcctttgaggaaaaatttccgctgaaagaattaaataatccagagcatgacagttacgcaattagtgaaaagagtcacggcagagaagaaatccgtcttcatattgtttgcgaagtccctgatgaacttattgatttcacgtttgaatggaaagggctgaagaaattatgcgtggcagtctcctttcggtccataatagcagaacaaaagaaagagccaaaaatgacggtcagatattatatca

SEQ ID NO: 12 - DNA  (genomic), 3660 bp; double-stranded, linear
gcaccgtgagacggcccgcagcttcggcggggcgggcagtacagcggggtacgaacaggtcacggcgtacaccctcacagggcagctacagagcaggcacctgaacctcccgcagcttgactgtgactacgactggaacgacaacggacagctaatccgcatcagcggcccgcaggagagccgggagtaccgttacagcgacacgggaaggctgacgggcgtccacaccacggcagcgaacctggatatcgatatcccgtatgcaacggacccggcaggaaaccggctgccggacccggaactgcatccggacagcacgctcacggcgtggccggataaccgcatcgcggaagatgcgcactatgtctaccgctacgatgaatacggcaggctgacggagaagacggaccgcattccggaaggggttatccggatgcacgacgagcggacccaccactaccattacgacaaccagcaccgcctggtgttctacacgcggatacaatacggcgagccgctggtcgagagccgctacctctatgacccgctggccgccggacggggaaacgggtgtggcggcgggagcgtgacctgacggggtggatgtcgctgtcgcgtaaaccggaggtgacctggtacgggtgggacggcgacaggctgacgacggtacagaccggcaccacacgtatccagacggtataccggccggggagcttcacaccgctcatccgcatcgaaacggagaacggcgagcgggagaaagcgcagcgccgcagcctggcggagaaactccagcaggaagggagtgaggacggtcacggtgtggtgttcccggcagaactggtgaggatgctggacaggctggaggaagaaatccgggcagaccgcgtgagcagtgaaagccgggcgtggcttgcgcagtgcggactgacggtggagcaactggaaaaacaggtggagccggaatacacgccggcgcgcacgctgcatctgtaccactgtgaccaccggggactgccgctggcgcttatcagcgaagacggcaatacggcgtggagcgcggaatatgatgaatggggcaaccagcttaatgaggagaacccgcatcacctgcaccagccgtaccgtctgccgggccagcagcatgatgaggagtcggggctgtactataatcgtcaccggtactacgatccgttgcaggggcggtatatcaccccggacccgattgggttgagaggtggatggaatatgtatcagtatccgttgaatcccatacaagtgatagacccaatggggttagatgcgattgagaatatgacatcaggtggactaatttatgccgtatctggtgtacctggattgattgttgcaaacagcattactaacagtgcttaccagttcggttatgatatggatgctattgttggcggagctcataatggggccgccgatgcaatgagatattgttacttgatgtgtcgaatgactaagacatttggatcaacaatagctgacgtgataggtaaaaatcatgaggcggctggggatagacaaggtcagccagctaaagaaagaatcatggatcttaaaaataacactgtcggtattgcttgtggcgatttttctgccaaatgtagcgatgcatgtattgaaaaatataacattgggcaactcttcgggttagatggtataaaagcagataatccaataaaagcaaagcaagggagttcagatgcttcaaattattagaggcaaacttgtcatttttttaattaccctttgtttatttgttgtttaccttgggtttgataacaattcaaattctgacatcgtattttatggacataaaacaccaaagagcgttgagatatatctttctgaaaaaatattatttataaaataattaatgaccaaaaaattagtagagggaatggtcattttataagtataatggttaataattacaagacgcactgtggagtggttgatataaatcttaattttttcaatgatattctttatagcgtgcgattaaaaaacattagtaaactggagaatatggagttctgcgctacaaaacaacgggtgtattttagtgataaaaacaagaaggctagttataaaataattaattatggagactattatgatgttgattattatgataacaatttgaaaaatgaagtttttgactggattggtaaatggtcataatgaacaacaccagaaagagaaaaatataaaatacatacagaaagacatgagagcaagggacggggcagggcaagatcatgaaaatcgtgatgtaaatcacgattttcatcctggctttaacgcctacaggtgatcaaaatttaacctttggaataactaaaaagataaaaaggacgccaggtgagtattcaaagtttgcttgattatatttcagtgatccctgatatacgacaacaaggaaaggttaaacataaattatctgatattttgtttctcaccgtatgtgcagtaattgcaggtgccgatgagtggcaggaaattgaagattttggacatgaaagacttgaatggctaaagaaatatggtgattttgataatggcattccggtcgatgacaccattgcacgcgttgtgagtaacattgacagtttggcctttgaaaagatatttattgaatggatgcaggagtgccatgaaatcactgatggtgaaattatagcaatagatggaaagaccataagaggctcctttgataagggaaaaagaaaaggagcaatccatatggtgagtgcattctcgaacgaaaatggtgttgtactggggcaggtaaaaacggaagccaaaagtaatgagattacagccattccagagttgcttaacctactggatttaaagaaaaatttgataaccattgatgctatgggctgtcagaaagatatcgcttcgaagatcaaagataaaaaagcagattatcttctggcagtaaaaggcaatcaggggaaattacatcatgcattcgaggaaaaatttcctgtaaatgtgttttctaattataaaggcgattcgtttagtacgcaggagataagtcatggaagaaaagaaacacgtttgcatattgtcagtaacgtaacgcctgaattttgtgattttgaattcgaatggaagggattaaaaaagctttgtgtagcattgtcattcaggcagaagaaagaagataaatcagcagaaggtgtaagcatccgatattatatttcatcaaaggatatggatgctaaagaatttgcacatgctatcagagcgcactggctgatcgagcacagtcttcattgggtgttagatgtaaaaatgaatgaagatgccagccggataagaagaggaaacgcagccgaaataatatctggaataaagaagatggcactgaatttattaagagattgcaaagacattaagggtggggtgaagaggaaaagaaagaaggttgcgttaaacacatgttatatagaagaagtgcttgcatcctgctcagagcttgggtttcgaactgacaaaatgaaaaatttaacacagatttaattcatgctcttgccctgcggggggattattaaatcttcccagttttttattatttaactctcgctcagcacactaaacatccctttctgaatt

SEQ ID NO: 13 - DNA  (genomic), 10523 bp; double-stranded, linear
acatcattagtaccttccttattttttgactgggacaaatttgggaccgatgggttcaggatcgagtctatttgccgtgcgtgttcggtaaggtgattaggtgcaaggtgagcatatcgacgaaccatttcgatagactcccagcctcccatttcctgtaacactgacaacgggactccggcttgaaccagccaacttgcccaggtgtgtctcaagtcgtgaaatctgaaatcatcaataccagcccgtctcagcgccgctttccaggctgtgtttgcgtcataccgcatcttccttactgttggcgctttcgttccgtctggtttggtacagctttccttgtacacaaatacccaacggtgatgattaccgatttgttttttcaatacgcgacatgcagtatcattcagcgcaacgccaattgcgcggtttgatttactctcttccgggtttatccatgccacccggcgctgcatatctatttgttgccattcaaggttgatgatgttcgagcgtcttaagcctgttgccagtgcaaattcaacaacagactttaatggctccggacattcatcaatcagcctttgtgcttcatggggctccagccagcggagccgtttattctttggttgaggcactttaataattggtgccttatcgagcattttccattcacgctctgcggctcttagcagggcctttataaatgaaagatgcgtagccttcgttgcaacggacgctggttttggcgtgtattctggaacaggtttccctttttttctgcatgcttctgccctgagtttccagttttcctcatgacgccggttcgtcattttctgcattgctgaataaatttttgattcagtaatgtctcttagttgcattcctgcgaaatgttgaagccagaatccgatctgctttccattgagcctgtttctctgcgcgacgttcgcggcggcgtgtttgtgcatccatctggattctcctgttagttagctttggttgtgtgtgggagtcgtagtcctgaacgaaaacaccccgcaatggcacattggctgctaatccggattcgcacttccggccaatgcttcgtttcgtatcacacacaccaaagccttctgctttgaatgctgcccttcttcagggcttaatttttaagagcatcaccttcatggtggttagtgcgtcctgctgatgtgcttagtatcaccgctagtggtatttgtgtcaacaccgccagaagataatttatcaccgcagatggttatctgtatgttttttatatagatttattttttgcagggttgtgtggcttgggaggtgatcgagagatcagaattgcgttgtttagtgagttgcacctattaattttaaaataaatacaattggtgtttttcgagtttttcttaactcttcatgcagctccgttctcagaatatatgatttttcgagtttgaaattcttgcgaccaggcgtcttattgccaggctcaggaagtggaaggcgtgtttgaatgtcgagtggtggacagtcatagaagtaaattctataaagctcaagcggttccctacgttcttgtgattgacgttttccattaagatgggaaagaaccattgaccatattactttcattatgcattgcgcagtcagttcatgctcggcgaagtgtttacgatgcgtagcatgaacacgctgcatgaaaaaacccgcatcaattaaaattgctgctttcttcataagagtcccaaaaaaatagcccagagccgttatgcagatattaacaattgtctgcgaacggggctgggcttggtttaattaatctatgccaagttgactgtgccgtcaacataaaacttacttcctatcacccaaacgtctcttcaggccactgactagcgataactttccccacaacggaacaactctcattgcatgggatcattgggtattgtgggtttagtggctgtagaaacacctgaccgctatccctgatcagtttcttgaaggtaaactcatcaccaccaagtctggctatacagaaatcgcctggctcaacagcctgctcagggtcaaccagaattaacatcccgtcaggaaagctgggcttggatcctgttggtgcggtcatggaattaccttcaacctcaagccagaatgcagagccactggcttttttggttgtgcttacccatttctccgcatcgcctttggtaaaggttctaagctcaggcgagaacatcccggcctgaacatgagaaaaaacagggtactcatactcacttctaagtgacggctgcatactaaccgcttcatacatctcgtagatttctctggcgattgaagggctaaattcttcaacgctaacgttgagaatttttgcaagcaatgcggcgttataagcatttaatgcattgatgccattaaataaagcaccaacgcctgactgccccatccccatcttgtctgcgacagattcctgggataagccaagttcatttttctttttttcataaatagctttaaggcgacgtgcgtcctcaagctgctcttgtgttaatggtttcttttttgcgctcatacgttaaatctatcaccgcaagggataaatatctaacaccgcgcgtgttgactactttacctttggcggtgataatggttgcatgtactaaggaggttgtatggaacaacgcataaccctgaaagattatgcaatgcgctttgggcaaaccaagacagctaaagatctcggcgtatatcaaagcgcgatcaacaaggccattcatgcaggccgaaagatttttttaactataaacgctgatggaagcgtttatgcggaagaggtaaagcccttcccgagtaacaaaaaaacaacagcataaataaccccgctcttacacattccagccctgaaaaagggcatccaattaaaccacacctatggtgtatgcatttatttgcatacattcaatcaattgttatctaaggaaatacttacatatggttcgtgcaaacaaacgcaacgaggctctacgaatcgagagtgcgttgcttaacaaaatcgcaatgcttggaactgagaagacagcggaagctgtgggagttgataagtcgcagatcagcaggtggaagagagactggattccaaagttctcaatgctgcttgctgttcttgaatggggggtcgttgacgacgacatggctcgattggcgcgacaagttgctgcgattctcaccaataaaaaacgcccggcggcaaccgagcgttctgaacaaatccagatggagttctgaggtcattactggatctatcaacaggagtcattatgacaaatacagcaaaaatactcaacttcggcagaggtaactttgccggacaggagcgtaatgtggcagatctcgatgatggttacgccagactatcaaatatgctgcttgaggcttattcgggcgcagatctgaccaagcgacagtttaaagtgctgcttgccattctgcgtaaaacctatgggtggaataaaccaatggacagaatcaccgattctcaacttagcgagattacaaagttacctgtcaaacggtgcaatgaagccaagttagaactcgtcagaatgaatattatcaagcagcaaggcggcatgtttggaccaaataaaaacatctcagaatggtgtatccctcaaaacgagggaaaatcccctaaaacgagggataaaacatccctcaaattgggggattgctatccctcaaattgggggattgctatccctcaaaacagggggacacaaaagacactattacaaaagaaaaaagaaaagattattcgtccgagaattctggcgaatcctctgaccagccagaaaacgatctttctgtggttaaaccggatgctgcaattcagagcggcagcaagtggggaacagcagaagacctgaccgccgcagagtggatgtttgacatggtgaagaccatcgcgccatcagccagaaaaccgaattttgctgggtgggctaacgatatccgcctgatgcgtgaacgtgacggacgtaaccaccgcgatatgtgtgtgcttttccgctgggcctgccaggacaacttctggtccggtaacgtgctgagtccggccaaactccgcgacaagtggacccagctcgaaatcaaccgtaacaagcaacaggcaggcgtgacagccagcaaaccaaaactcgacctgacaaacactgactggatttacggggtggatttatgaaaaacatcgccgcacagatggttaactttgaccgtgagcagatgcgtcggatcgccaacatcgataaccaggacatgacgatatcggtctgggtctttcctgatactgatatttcagatgtatcgcgtgagttaattgcggcaattaaacaggggtatctaacagtaaaagccgccggggtatgggcggggggcattgaaacaccttcggtggaaactccatcggaaggctctaaattttttggttttgatatggataacgaattcatcagtggttttgatgtaggggcatggggagtattactctgatggcgaaaaatgactttaaagcgtttgcaactgatcgaaatgccaatgttatgtcgcaggaggaatgggaagcgttgcctgcgcttatatccggatttacagcagggaaagcatccagtgcgcaagtcaataaggttattcggcaggccagctttattgctgcagctctggcccagtttgtaagtgataaaacgcaacgggatgtgcttgataatggtgatctgcccggttttgttgaattgctgggatcggggtttgctgttgaatacctgagccgcaagaatccgtttggcgatatcaaatcggacggcacggtgaaaacggctcttcaaaaccttggtttgggagaagcggcaaaacgggatgtggggacaggggaaaatcagataccggacatggcctcttttgccagtggtaatggatggatgaaattacccaacgggaaaatcctgcaatatggtcgtggtgcggttacgccgacattatcgacgcaaacaatgagaattacattcagcatccctttccccaaaaaagcggactgcgccatgcttactcattctggtgatggcggtgcgcctttaggcgctgggcgagggttcgtgatgactgcagaaggcccaacgttaaccggctttaattctgcttacagaacgtcatcaaccagcgacacggtatcgatgaattacagttggtgggctgttggtgagtaattttattcagggtgatttatatggacgaatatgtttatagcgcaaggcataatgcttttttccctgtggatatgattgataaatataaatcagagggatgggatttatcagacgctaaggaagtaaatcaaaatattatcagtgagtttatggctgaaccgccacaaggaaaaatccgtattgccggagatgatgggctgcctgcgtgggcagatattcctccacccacgcatgaagagcttattgaaattactgaatcagaaagacagctactaattaaccaggccaacgaatacatgaacagtaagcaatggcccggtaaagcggctattggtcgtctgaaaggtgacgaactgacgcaatataatttgtggctggattatctggacgcactggagctggtcgatacttccggtgcgccagatattgaatggcctacgcctccggcagttcaggccagatgacatccggcgcggtgctggtatctgttgccgtcaccgcgtcaatgtaatccagcacggcgttaagtcgggttgtttctgcctgagtcagtttccgtccggcctgtaacttcagctgaatcagactaatggaagccattgctgcatcaatcagtgattggcgctgtgcttctgccgcgtctactgcggcactgtgttgtgcctcagtgtctgtcacccatttctcaccatcccatttatcgtatggcgttaacggtgaaatcgtgacataaccgtctttgatggcaccgatataatccactgtaacagctgcgccattttcgattgagtaaacagtctcattgcgatggtcttcttcatggctccatcccttacctgtaaatactgccactcttcccggaatgttttcgccagggtcaataccagtggaacaggcgggcatacttacgccagtattaatatattcatcagaccagcccgtatactcagatgtttcagcatcataataaaaacaacgcatatcgcccggcactgtagccagcccattttcatcaaaaacaggtttcattatttagccctcaccagaaagttaaatgcaatatttcgcggtctgactgcaacaaaattcacaccatcacccacagagttactggtgaaattaaatcgtgaaaatcctggctgatttccggcgatgccatcatgaaagttaattgcgtgtcccgcaccttcgcctatattcccggcaaactgagaaaagtttgtagctgcctgccagcttaataattcgcgaccaccgtctgcacctcgcccgtcatcccagatacgaatgaaatcaccgcgggcttcaggtaataccagcgaaggaaacactttcgccagcacaggataatcagtggcagagaatttcgcgccgttgaacttcaaaaacaccatacaggaccagctgtcgattacagtatttggcattgcagcggacggccagaagaacggaacgccaatagctggagcaccttctcccaaaccaacgtttatgaaaatgcagaaataacgagcaaatggcatcattcctgcttttgtcagggagatctaccatgcttattggctatgtacgtgtgtcaacaaatgaccagaacacagatctacaacgtaatgcgctgaactgtgcaggatgcgagctgatttttgaagacaagataagcggtacaaagtccgaaaggccgggactgaaaaaactgctcaggacattatcggcaggtgacactctggttgtctggaaactggatcggctggggcgcagtatgcggcatctggtcattctggttgaggagttgcgcgaacgtggcgttaattttcgcagcctgacggatgctattgataccagtaccccaatggggcgctttttctttcatgtgatgggggccctggctgaaatggaacgagaactgattgttgaacgaacaaaagctggactggaagctgctcgcgcacagggacgaattggtggacgtcgtcccaaacttacaccagaacaatgggcgcaggccggacgattaattgcagcaggaattcctcgccagaaggtagcgatcatctatgatgttggtgtatcgacactgtataagaagtttccggccggagataaatgaaaccgtagcacgtcgtatgcaagatcgtgctgcggtttatgcttaccacttgaagattcaaaaattaggtgagtaacgaactggagacatagctcctttttttcttaattcatctggtatttttttcccaagataaaggtttgctatttcaggtggggcttctcgaccttcaaaaccatagcgagagctttgtgttgcctcaaagtcagggtcttcgtcccagtatttcatcgtaggaaaatgttcacgcgttgattttagccatttatcagcaatgaaaactcctcgaacgatcccccttacagtagcaagaatgacttctgctttactggcgcgcgagacattaatgcgccagctaaatcgaaccgcatcataaagctctgaatcttttgcacttctgttaacggaaatcattaatgctttatgatgaaatgttatggtttcgggttgatatgttgctatcaactctttgacatgcgcggcgccgaattcattgctgccagcaccattcatgatattcgttaacccagggtaggcatcaataagtgctgcttcaacttcgtacgccgtcttttcatcagtcattccatgtcgatggatgacatggataacttcaagtcccgctaatcttatttctctgatttgctttagcttgttgctcagtaagtcgtcatcatcagccgctgccacttcaccgcgcatatgggcaaatacgcggttacctttgcctttccctacatagaaggtgcttccgtccctaggatcaatcaatcggtatacataccagccaaggtgttcaattactccagaaggaaactcagtaatatccattttgcaatatctgtgaattatttgtgagacgtatattaatgaacattgcaagggctcacaactagtagtgttgagaaagccatcgggaaaatgaggctaaccctttgaatttacatagcgcaaaaagatacctttcctcataatgtgagctaattttatgtttcgtttgatgatcgggtcggtctcgaaaaccggagtaggggcaactctaccgggggttcaaatccccctctctccgccactttatcaatgacttatctcccgacttcccgtcttgcttttcctaaacagaacaatcgtagaatattcttgaagggttagatcgtcactgttttctgttcgatactgtgacattcagcacttgattcgctatggatctgacaggaaggttttgagcgaaaatctgcagttattcagtcgttttcttatcggtcaccattattcttttagacattgatcctacaaagctgccgcaaagttggtggtgggaactgaagttgcgtagagaaggggtcaatacccggaggcaaacatgggctggcaaaagtgtagcggtattaggcgcagctatttagcctagttatgttttatgaaaacttgatatcatataagtgtcttacttattggctgtaaataagtttttcctaaggaattgtttcttgagtatcatttgtaactgtaacggaatttataatcctttgctttattgttacggtattttttatcacaccctatttttagtggttttttatactgaagtttggcaaagtgaactttatatacatatacttcatcctggtttcagttaaattggggggatgatatggcaactacatgttcagttatattgattttggagtcctttgatgtttatttcggaaaagagagtgtgtttctggagagaggttcatctgtacttgtcgactctagctctagagattttttcctgacatatcctgaaagagtgatagtggcggattttggcgctgagtttattagtcgctatttgaaagctaataacttaagggatatttctgattgtagggaatatccatcttatttaaaaataaactttgctgacttcagtttaattaaaggattaattagttgggctaatcactgtgctgaatacatagaaatttttgatgagtctattgctttaacatgtctctctgcattttcttctgaaaaacaatttggagtatttctgtttggatgtttgaaaagcacaggggctaaagttaaaacgattattcatacggatttatctgcaccatggcgtcttaaggatatatcatcaagattatatctcagcgaaagtttactaaagaggaaattgaaagaagagggggtatcattcagtaagatcatacttgatgagaggatgcaaatggctgaatatttactcagcactcgttgttatcctattagtaaagtagctaaggtctgtggttatgccagtgtctcatactttacttatgtatttagacgttattttggtgtttctccaagtcaatactctcagaggagttcagaaagtaaaattcttactcaccagggaatctgatcattgttcttgcccccttatttccagacagggggggtatcttaagttaacgttacccgctgacgtcgatattctcgcggagagcgataacccaacgcactgtgcggatggttttcattgtaatgttcgatcgccactgcaagattatgcaatgccgttcttacattcggtttcggcatgaacgcgatgtagtcttccttcatcgttttcacgaacctttctgcaattccattactctgaggactgctgattgccgttgtgcagggctccagattcaactctctggcgaactgccgtgtttcatgcgctctatacgctgaaccgttatctgtcagccactggatggactgttccggtactttatcgccaaagcgtttttctatcgctcctaacatgacatcctgcactgtcgctttatcgtaacctcccgtgcttgcggcccagtctatggcttcacgatcgcaacagtccagggcgattcatctgggccaatccttgctcataacaggcattcacttcagtcatggcagaaaggtatgcatgctggagaagtcgtgaaagaaaagaagactgctgcgccgtttgtcgtcacgtttatcttcattggctatgcaagtcgtaatacaaggtgggacaaaactgagacacataaggcctcgcaatggcttgcaaggctttacatgttttgatgtggtgggacgtgtgagcgcagtgttgatggggtaatgctttgaattagaagcggattcttata

SEQ ID NO: 14 - DNA  (genomic), 12886 bp; double-stranded, linear
ctcaacttcctcaaacgtccgtattagtccataaaatctctgatttataacattttttattcttttaagtccatagtagtccgtaaccatccagtagaatccggtactgaatgtgtataggattgtgtatatgttcctgttcggtctggattcctatacacatgcctttaaacgatatgcagattcgccgcgctaagcctgaagctaaagcctatacatttggagatgggctagggttgtcattacttatagaacctaatggaagcaagagttggcggttccgctatcgctatgccggcaaacccaaaatgatctcgcttggtgtttacccaacgatcacccttgccgatgctcgttcccgtcgtgatgaagctcgaaaacttgtggcagaaggaaagaaccctagtgaggttcgaaaagagcaaaagctagctatgcaaacagagtcagagaacgccttcgaaaagatagccagagagtggcatcaacttaaatctgctaaatggtcggcgggatatgcatcagacatcatggaagcgtttaagaacgacatttttccttatgtcggaacaaggcctgtgggagagattaaaccgctagagctgctgaacgttctgcgtaaaattgagaaacgtggtgcgttggagaaaatgcgcaaagtgcggcagcgttgctccgaagtgtttcgctacgcaattgcaacgggtagggcggagtacaatcctgcggctgatctctccagcgctctcgaagtacaccaatccaatcatttcccattcctaaaagctgatgagatacctgattttctacgtgccttagagggttactccgggagtaagcttgtccagatagccacgaaattactgatgattacgggtgtgagaaccatcgaattacgcgcggcattatggcaagaatttgatctggataacgctatttgggaaattcctgctgaaaggatgaaaatgcgtaggccacatcttgtgccctatcatctcaagcggtagatttactcaatgaactcaagatcatgacagggaactatcgttatgtttttccagggcggaacgatccgaataggccaatgagcgaagcgagtataaatcaagccattaagcgtattgggtatggaggaaaagtcactggacatggttttcgtcataccctttctacaatcctgcatgagcaaggttttgagagtgcttggattgaaatccagttggctcatgtagataaaaattctattagggggacttataaccatgctcaatattttagtggaaggaagtctatgatggactggtacagtaatttgatatttgaaagactaaaaaggagttaatttgtgtctcaaccactttcggaaatattgacatgggatgatgaacaatgggaggtatttgtccatgattggcttattgtctgtaaatcagatgattacccgtggagcgaacgtttgggaggagctggagataaaggtagagacgttgttggatataaatcggatcctaacgtagaaggttattcttgggataattatcaatgcaaactgtacaaaaaaagtttagggttctctgatgttgtagttgagtttggaaaacttatctattttactctgaatggtgattatcccatccctcagaagtacttttttgtggcaccctatgatttatctactacattttctaatttattgaaaaataaaaacgagcttaaaaaagcagtccttgattcatgggattcagcaatttcaaaaaaataactaaaaagattgatattccattagatgatgaaataaaaaaatatattgaggattttgattttagtattttttactctctacccttatcattgattttaaatgatattgcaaatacacacctttattttaagtactttaacgagctgtatgtcgtgagaatccctccaaatgaaattccaacatacaattcaaaaaaagagtctgtatatgttaatgcactgcttcaagcctattcagagcatggaaataaaacttatagttctttcttagagcttgatgatccatacagacgacactttaataatagtagaaatgatttttattttgcatcttcgcttgaggtttttgtccgcgaagtatttaaagatgatgtattcaaagcattgaaatgttacatttcatcttcaattgaacccgtcttttatgaagaccataattatgcatttattaggtgtaatgcagtcttgaagcaggctgttctgacaccaattgcacattcagtactatcaaaaatatgtgaagcaaatgataaaaaaggaatatgccatcatttggttaatgatggtgaagtaatttggacggtgagataatggttagaatttataattcaagtttagaagtggcatgtcgaatggcgaaagtgctcgtcgctatttatccttcttcattaagccttgaacggcttatttgttttgattttattttagtaaatcttaaggattttttacctgaagagattagtcttcatcctccaataccccgtagagatgctcagttagccctaaaacgagagattgttttagaatcattggctttgttgcaaggctatgaactagcctcaaaaatttatacacatcgtggttttgtatataaagcttctgaaaaaacatatgcatttacaaattctctacataatgaatatgttgcgcagatggagcataatataaatttggtggttaagttatatagtgatattcctgatgagcagttgcaatcaattataaaaaataaaattggcaaatatgatatggaatttaattatgaatgacaatttttttaccgttcagaaaaataaaggtaacccggattcaataaattagatgctataattgaatttggttctaaattgactattttatatggtggttctgactctggaaaaacatacatatattatttgattcgatatttattagggagtgaaaaactaaaaaataaagatatcgatcatgctcaaggttatgatttagcctatctggaatttaattttcaaggtagggtaatgacaattgagaggtctcttcaggatagcgcccattacagattatatgattcgagcattgaaaatgttagtgaagctaatctgttgatggttttttccaaaagtgcttcgtctaaaaagagtttttcatcatacttttatggtaggttgaatttcaaagaggctaaagtaagaacaaacttaagtaatactcttcataaatttaatcttaataatgtttttgaatttttttgtattgatgaattaagagtgttaactgagaagtcgttaattctttctgatattcctagcgaggagacaaaaagaaagtctgaatttaaattccttttaactcagagagatgatcctactccttagcagaaaacccaataaaaaagccagatatttttaaaaaaatccaattgccaatatttatgaggaattgaaagngcaatttatttatcctgaatanganccagncnntgnttccanagaacntnanaaagnanagccanatnttnaatcntcgaaanananattnaaaggnattgntnangcccttgatgataanaagccattnttnaaanagntaagngatgnattanattcnatcngggncngggnaaaaaacttatcnttacncnttgnaanatttagtnttnttaaagncccanacnttanagatnnacnaanaananatgntgnatcncnggcgnanttnnatttnaanaattttgcnganatttantgngagntntgnaaaaccccnccaaaaaaagnaaatggaanatcntatgatgattgntttttgncgngnaaagcngaaaaattnaaaatccaaagccngctgaaaggattaattgnatccatcggatntaanggtngcgnacntgaattaattatgttaagaaaaaatgatgttaatgaaatttatcaatcagaaaaaagtgattttaagacgttagaagataaaaatataaaacaatacattcatctcttgaatcactttatgaatataaagacaatcttttaatggatcacacaaaacatagcattctatcttcattacaagataaagaagatgatgttgacgaacttaaatactccgccgaggactttgactccttaacagtagctgatttgtatgatatagaaatagcgatgcaagactttttgaatgatataaattttgaaaattctaaagataacaaagtgcgatttgacgaagatacatatgactttaatatcaatgggaaacgccgaggaatgtttggtaaaggtacccgtgcagtaatgcatgctatatttaccatttgctttgcggaatttttatcaagaaaagggaatccattcattggatttgttgtgcttgatagtccattagtgacgcactttgataaagatagaggggttctctatcggatgttaatagcgtcagtctcagtgattcattttatcacgcattaatcaaaagggactataatttccagattgtaattcttgagaataaaggtccgacgttccaaataaaaattaatgatgcaaataaaatccataacttaaataagaatggaagctctggtttttatcctgtttaatacattaaaaatataactgctaattggggtgctcgaaattatatttcgtttcgagcgctcagttcatttctaaataatttgcaaaattattttgggtactttcgcctctacacttccttcgggtggttccacaataatggatctcaccggcgtttgatattttataatctaaccccttagcgcgcgcagccccccacgcctgctcgcttcgcttaacagactggttttcatgcattccgcaaatcgtctcagaagccaccacacaagggctttcgcgtcaaaaatggtgcatgagaatcatgcgttttcatgcgctatagacatgcactcatgcgctctcaggccagccagggaaaaggcgtaaaaaatcccagtactggaccgggattacgtgggctttttttgctaatcagacaggaatttgctgacggcttgacagctttgacgcggagccatagcgattgagagtttgctgttgtttttccggcatttgtgctttctctgattcctgttcattgcgccggggcttcatgattatcgtatccacactttccagtgcggtaaatgtgtaggaacattcaagattctggcactgataccatgagcgtttaaccgatggtgcttcataggcggaggttctggcgtgtgccgtcgtaccgcattcgggacatttaagtgccattaatattactcctgcatgccgttaatgtaatccagacgttgctgaaagcgcagttgttgtgcaggggtgtaagagctctggcaatcacgaaccatcatggggtcaggcatcacaccggattcatccagaatcatacgataatccccggcaatttcaggcggtgttattgccagctggcgaaccagagcattgcgtaatatacgggacgcaacgtcaacccctccgcgccccttcaggaacggagccagtgcagatgtcagggctgctccattcgcctgcataaaattgctgagagcgtcttctgtgcaggcctccatcagttgatgctgcgagtaaatgcattcgcgcgcagcacagttaatttgccatttcagcacatccagatgttcccgctgtaattcgagctgtcgagcataatctgctggtttttccatggcagtgaggagtgattctatctgttgttcaacggcttttcggctctcactatgtccagcccacagaatacgggcatttctaaaactgataagcgcttggtctggagtgactcgggccatcatactgctttctccttctcagcacgttcctgacgaaccttcattttatgcatagctgctggagagagtttattactgaaatccagacgggccgcataatccggggcaactcccgccagtttaaacacggggtcctgttcgggcatcgcatcgttagtcagagccggtctggtgatatgtttatgaataaaatctttcagcagtgtgtccgggtcattaactgaatgcaccacaccgacaactgcgctggcttccctgcccattgttgatttgagcaggcttagtgtctggattagtgcttttccatgcgactgcataaaatcttcccagatttgttttgcgcgaatacccacaagggtgtcgtgcgcgtggatatactttccggctaattccgcagcctcctgcggcaaaagtgcattttcgctttcctgagccgccagcagctcatcaaaatcctcaagcgtttctcgtcccagcgcaatttccgtgcgcagttttttcatttcctttgagactacgccctgactttcacgaaatagcgtgcgccactcctcattcagggcgttcgtcgtggcttccatttcagcgcggcgctggcggattgtcgcaatattatccgctgccgctttttgctgacgacgtgcttcaagccatgcagatttggtggcattcactttctcaagcgcctgttgcgtcgaaacagggatagaaatttcaacgatcgggttattgttctgttctgggattgtcatgtcagcacctagtggtttgtcgtggtgtcaattgtgctgtgatgcatacaaagctgccattgaacgccattgtgcgagcgacaagacaaagactgaaccgccccggacctcttttggctagccagaaaaggcctcgtttaactaaggctgtttcagacttaccttaactattcactactattcacttaggtaaaaaaaataggtaatacagaaggttataaggtgaagggttggcatggcagtattcatcgactgttcataactgttcacatgggaataaaattatttatggtattttttcataatgggtggtttttttattcctcgtagctatttgttttttgctcctcaccactattcacccttattcaggagtattcaacaggcacataaatagactgcatgtttttgccggggaataacattttcgcctctggccatggtgttgcatttcatactgatttttataaaactagatctgtccggttctttatggattcattcggatatattttacgatttaaggtgatgttatttaatatcaaggtttttatgcaggcccaatgtttataagttggatgcgattcaaaaatatgcccggaaattggggcctgcaatgcaaggcctcgtgtagaagttgtactgccttgctgtattggcggtggggttagcactatcaggtgcaatgacccataggatagtaaaccctgggtgaatggtagttcctattaatgctcctgtatttatagtccgcaggcatggtatttattatgtcattttatatggtttaatcgggctttaaattccataaaatcaatatgtgacgctaaataaaaaatgcgtgcgcaggtggtttatatacacataataaggaactacctgaacccggataaattcatccggactgttgtggaaattaaagagggtagataaatgcgtaatatttctgtgtctgcgccagctcctgctgcgccattatttcctgtatcgaaccatcatgagcgatttttacgcctgcctgaggtgatgcacttatgcgggttgtcccgttcgaccgtttacgacctgatcagccgcgatgcgtttccgaagcagatcccgcttggcggtaaaaatgtcgcctgggcacagtctgaggtcagcgcatggatggcggaccgcatcagcgcccgtgggcggggatgtgatgcatgatgatacctgcatacattaaatacctttattctggcttgcttactgtcgtcatttccaggtatagtttttccgctgtcgcaaaatcggcagccggaattggcgttccgtataacttattggcgacaattgacgccccttgcgtctttttttacgtcgtagctcaggcacaaccattttcagggctgtggtgtttatgcttacaccatggttctatcgagataatggtagtccgggcggggcagccttcgggctggccggtttccaataaggccggttacgccaaccccgttcgggctgccaccagtgaaattggcgtttccggtggtagcaataaccgctacttattggaggctgccatcatggctacaatcctcaccccgtcacacccgcaatatgtctttgtgtttgccgcaatccgccgtgctgacactcacccccgcatctgtatgcttcgcactgtctcctgcgatgagcgttccgcgcgccgtttgctagtccgagattatgtactctccctttctgcacggctgcctgccggggaggtgacgctatgaaccagtttgagatttcctacgacgatgttgtaaggctgaaacatttacgcaatgtgggtgagtatgtaactggcatggcagccctgcaggactgttatgaaaagccagcaggtgcccaatgcgaacaactggtttccctcatttatctgatgacagagcaactggatggagtggtgcaacgctgccatgacgacctgatgaatgcggaggtggcctgatgatatgctgtgaatctcttctggcacttcgtgccgctctgtatcgccgtgccgttgcctgtgcctggctggctctaagcaatcatcaggaacgttattccggcctgacgctcgctgaacttgaagatgccatagcccgcgagctggaagggttctatctgcgccagcatgggcagcaaagagggctggaaattgcctgcgcgttgctttcggatctgatggagtcggggccgcttaaagcctgtccggttctctcactgctcggaatgacggtcatggatgaactttgttcccgtcacctcaacaaaccagcgctgcactaaggagggccgcacaatgtcaggaatgaaagttagccaggctgagaaagcagctcggggtcactggtcaagaattttacctgcgctgggcgtaaatgtactgaaaaatcggcaccagccctgcccggtctgtgccgggaaagaccgctttcgatttgatgaccaggaagggcggggaacgtggttctgtaaccagtgcggggcaggtgatggcctggcgcttgtaagtaaagtactggatgtaggcattagtgaagcggcagacagaataaacggcattatcggaaacctgctgccagtatctcagggaatgcttgaatctggttctcctgaaaaagaggacgggagaaaagctgcagcagtgctggctgcccgtttgtttgataagtcccgccagaccactggcaatgcctatctgacgagtaaagggtttcctgcactgccttgccgggaattaaccgctatgcataaagtcggtggtgtggcatttcgcgcgggagatcttgtcgttccattgtatgcagatggagagctggtaaatctgcagttaatcaacgctaatgggggcaaatgcttccttaaaggcggtcaggttaagaatgccttttacctggttgaaggtactgccaaagcagccaaacggctctggatagcggaaggatatgccaccgcacttactatcaactatctgactggcgatgctgtcatggtggccttttcgtccgtcaatttcctttccctggcgagcattgcctgcagtgagtacccaacgcaccagataattattgctgctgaccgcgatctcaacggtgcggggcaaacaaggggcgcagctgttaccggggcctgcaattgcacaatggcgctcccgcctgtgtttggtgactggaacgatgcattcacgcaaaacggcgaagaagccacccggcatgcaattcatgaagtaataaaaccagctgttgccagccccttcgacacaatgagcgaagctgaatttaccgcgctgagcgtcagcgaaaaagcgcagagggtagtggatcactataaaaattcactggcagtagacccgaacgggcagctcctttcacgctatgaggcgggggcctggaaagttatctattacgccgattttgcccgtgatgtcgctgcgctgtttcagcgcctcgacgcacctttttcatccgcgaaaattgcgtctctcgtggaaaccctcaaactgatcgttccgcaacagcagaatccggcgcggcaacttatcggatttcgcaacggtgtgctcgatacccggacaggattgttcagcccgcacgataagaagcactggttacgtacgctgtgcgaggtggattacacgcagcccgttgacggtgagtcactggaaacccatgccccggcattctggcgctggctggatcgtgccgcaggttttaatcctgaaaaacgggacattattctggctgcattgtttatggtgctggctaaccgttatgactggcagctgtttctggaggtcactggccctggcggaagtggaaagagtattcttgctgaaatagcaaccatgctggcgggtgaagataacgcgacctcggcaaccattgaaatgcttgagtcgccaagagaacgagctgcgttaataggtttttcactgattcgacttcccgaccaggaaaagtggagcggtgacggggccggactaaaagccatcactggcggcgatgcggtatccgttgatcccaaatatcagaacgcctattcaacccacatcccggcggtcatcctggctgtgaacaataatccgatgcgcttcactgatcgtagtggtggagtttcacgccgaagggtgatcctgcatttccccgaccagatagccccggaggaacgcgatacccagctcaaagagaaaattgccagtgagctagcggtgattgttcgccagcttatgcagcgtttcagcgacccaatgagtgccaggacattgcttcagtcacagcagaactccgatgaagcgctcaccatcaaacgtgatgctgattcagcttttgatttttgcggctaccttgaggtcctacctgacaccacgggcatgtttatggggaacgctaatattgttccacgtcagcctcgaacttacctctaccatgcctatctggtctacatggaggctaacggctataaaaatacgctcagtctgaccatgtttggcaaggggctaccgttaatgctcaaggaatatgggctgcagtatgagaaacgacggaccaatcaaggaatgcagactaatctggccctaagagaggaaagcaatgctgactggttgccaaaatgcgatgagtttgcagcgaaataactgacctaagaccggctgtgccggtcttaaatccgctacaggaaattatctcaaaatatatatcgataaaatttaaaagttatatgctaaggcgtcagcggaaaatgcatctaattcattgttagatgatgtttatttttgaattgatttaaacatcccatcgagttgtaatttatttatgtcggttttctttatggctttaattaagttttcaataacttccaaagaaaaaattacatctttcttttcaattctaacccccccgtggtggctgcaagcattaaggatgtcctttgtaatttcaacatcatttttcattaatggttcatagtccagagcctcaataacagaaactaaactacctagcatttgctcttggtattgaacgttgtttaaatgcattatacgaatattaacaagcatgagaatatattctaaatatctcctggcagtatttcctttctcttgtaaagaatcacgatcatattcctcaatactcatgacttcattatgtaaagaggctattttgtgctctgctaatgaaatatttatcgcatccatgaggtttcgtgagaagcctgtagatgtaacatgaccatttgcgggccttgttaaaatacatgtagtatagcaatttatatttggggtctggattgtctcatttactcttttaaccgttctataaacgtctaccatataagaacctgagttttcaaatgaacatgaagagcattttgtattatatattctatttagagataactgattgtgatagtatccctttaagaaagcatatatagtgtcattaaactcgacaaacacaacggactcaatatatatatggaatttatcattggggtgccactctaattcaagtcttcttgtagagtcatcaaaggaaaagtttgaaataaaatcccagttacctaaatctataaaatcaacgatatttctacctgcaccatggatatttttatttattaaagttgtgattgagttttttataatgtcccaatcatgaatttcatgatcgaatttattattgatggtttcttttatttgattggaaaagtttgaataactagtcacttgttagcctcaaaattaataatgagtattaaaatttaattgatattgtctataaaatgtagcgatgcaattttattgcaacgaaatgatttttacaacataccattatcgctaaacaaaatcgcacccatcaaatcaacttacgttacaatcactacaaagcgattgcatttaaattcaaaacagttttctgttgggcgcattttttgttgtactggactaaagagaaaaaatggggtaaggaacaaataccttccgtgctcaaaaattaggtttttatgcacttattaatcagtcaaggtgaacagtaaagtgttcacttcttatcaatcgttaatttcatatctttttgaatattaatgaaaaaaaacacaatgagtagtatgaacagttttcccccaaaaaaagttttttctgccttgagaatgcgcggaaagcgaacgccttcaccaatgtgtataggggtgtgtgtagtttaaatcttctattttaatttatgtattaaaatcattgtgttggtggcgattattggttcctattatcgcaccattt

SEQ ID NO: 15 - DNA  (genomic), 6133 bp; double-stranded, linear
attcacaagttcacgcggatgaacaggtgtgctgttggctgcgagataggagggagaggcaacgaccatttcacgctgcctgccggtaaggggcacagcaatcatgtctttttcaatgacctctccgagccttacgccagcatcgtaacctgcggccacgatatcgaattcctcatccgtgacaacaatatcaagcgtaacggctggattggctgctgcaaacgaagcgattagcggacctgaaagaaattcttcagctattgacgtcaccgcgattctgagaagtccgcgtggcacatggtcagaaaccatctcttcgaacgctgcctcaataccggataaaggtaatgacagcgatttatgcagccgttctcccgcttctgtcaaattaactgagcgcgtggtccgcattacaagcattgtcccgaatgcatcttcaaggcgtcttattccctgactgaccgctgaacgggtaacgcccagccgtgcggcggctttactaaaattactctcttctgctaccgcgataaaaatgggtaaaagattaagatcgattttcattgtttaatgccgctaaccactgagtacattgaaagcaggatactggaaccaatcataaagttctattctctctccgaacacatttgaaggagaacgtaatggataaggtcatattaattaccggcgcatcaagtggtattggggaaggtattgccagagagcttggaatgacaggtgcaaaggttttactgggagcacgcagagttgagcgtatcgaagccattgcaaccgaaatctgccgcgcaggaggaattgctaaagcgcgggagttggatgtcacagaccgacagtccatggccgatttcgtgcaagcagcgctggatagctgggggcgagttgatgttcttatcaataatgcgggcgttatgccgctttcaccgcttgcagcaggaaaacaagatgaatgggcgctcactattgacgtgaatatcaaaggtgtactgtggggaattggcgctgtacttccggtgatggaagcacagggttccggtcagataatcaatcttggttctattggtgccctttctgttgtgcccacaggcgcagtctattgtgcatcaaaatttgcagtacgggctatttctgatggcttacggcaggaaagctcgaaaatccgtgtgacctgcgtaaatcctggcgttgtcgaaagtgaactggcttcaaccattacccatgtggaaaccatgaaggcaatggacgcctaccgttctgttgcacttcaacccgcggatattgcccgtgctgtaaggcatattattgaatctcccgaaagcgttgatacaaccgaaattaccatcagacccactgcatctgcaaactgaagaataacttttacattcacgttttattaaataggtcagaaggaatatttatatatccctgtgtttttcatagcaagatacattatgtattgctcaccccgaaggagatgaaggtttaattacagaaagattatttttcacaggaagtaaacatgactcatgtttaatgtctttatatataaaactcatcctctcaattgtcagggaaattagcgtgaatactatctgttctttaattgttgtggttgcactgtctttattatcattcagtagcgtcgccaaaacgattactgccgtcggttcaaccattaacagcactgaaaaagaaatttctttacaggcagaaaaacaagggaaatcatataaaattctgggcgcgttttttaagaacagagtttatatgatagcaaagttaacaccagtcagtaaaaatgatgcttcataaggctcatggtataatttttaagacatgatcaagaagcacgtctattgactcaaaattgtcatttgtcaggcaatggaatacctgacaaatgacgctatcccaatctattgtaccagtcgttctgctaattctaccgatgcttcggtctggagtggtagagtaatattggacacagttttattttctctctttttcgagggctgtatatcaacaggaagaatacatccctaagcggttaatgctggagtaatcaatagaccagcattaatcacagatgattaccaatcagacagaaatggttaaatcgtcgaattcatatttaatacgttttcttacgccgctgaacagcttgaaaaggatgcatattttaaatatcagtgaaatgaacagtttattgccgttattaatagaaatggagggataaatacgcgtattctactgttgcaacaaaaacaacggtattgatcggttttcataatgaagtaacctgacagatatgaaaatgttgattgaggctaaatgcccggattaaggttgtcgaggggagccaggtggttttttcttttggatgatctccattgctggatagtccccttgtacagataagtccgctctttctcgctcaaagcggcccctggaattgaacgcagagtgactacctgacacaatattgcacagtgaagagtcggtcgttgttaacgttcagattttcaatgtatcaatgaccatccgcagagcgggggagacgttgcgatgagggtaatagagaaacaatccctccattcgcaggctgtaacgctgcaacactctgataagcttaccgtgttctaaatcatccgcgaccagttcaacaggaacataggccaacccgaggcccagccgggcggcttctgcttccatatagctgtcggaaaaggcccattgtccttcgggttgatgagtgatttttttatcatcctgattgagttcccactggtatacgctgccgtcggcaaactgataggcgatacagggatgcgcctttaaatccgccggggtttgcggaaaaccatagcgacgaaaatgttccggagtccccacaattgccatctccatatcgggcgtgatgcgtaccgcgaccatgccctggctgacttcaggccccaggcggacacctgcatcgaatctttcctcgatgatatcgacgaaccggctctcatttatcagttcaagctggatatcaggatatcgctgtttaaataccgccagctttggcagcaggcatttatcaatcgcgtgctggctggcattgatacgcaccgtgccggagggcgtctctcgatagtgcgccagcgtggcaagcccaagatctaacatttcaaatccagatgccgtcttctggtagagctgctcgcctgcttgcgtcagcgacagtttacgcgtggtgcgcaccagcagctggacgcccagcctttcttcaagctcgcgaacagaacggctgactcctgactgagcaagacccagccgcttagccgctgcggtaaagctgccttcccgcaccacctgcataaacaggtatagctcgttgtagttctccctttttgccattgaaacattccccttcatgccggcaatctcagcattaatttataacaatatggtattaatcttagcattaatcgccccctaatcagcactaattctgctcactataatgaccccatcaaagtaaagcaccgcagcgttgtccgtcggaaacctgtatctctctgttgttttttatggggatttttatgaaagccttcacccgaacgctaaaaaccgcgatgccggtcatgctgcttttcgcatcattaagtggagtcacgacaatgagttatgctgattcaaccaatcctaatgcccctgtgtccatgaccgataaatgggataaaacgttcgccgagagccagaaagtcgatcaccgtaaagtctcgttcccgaaccgatatggcatcaccttagtgggcgatctttacctgcctaaagaccgtggcgatcgcaagctggcggcgattgcggtcagtgggccatttggcgcggtgaaagagcaatccagcggcttgtatgcgcagacgctggcggaacgagggtttgttaccctggcgttcgatccttcttacaccggggaaagcggcggctatccgcgaaatgtcgcctcaccggatatcaacactgaagatttcagcgcggcggtggatttcttagggctgcaaaaagaggtagatcgcaaccgtatcgggctgctcggtatttgtggctggggcggcatggcgctgaacgacgcggcgatggatacccgcgttaaagcggttgctaccagcgtgatgtatgacatgagccgggcgatgggccatggtgtgggggatggcgaagaccgttattctaccgccgaccgtcgtgctgttctgcaatatttgaatgaacagcgctggaaggatgcgcagagcggaacgttcgctcacggtggtcatgatattaatgtcgatagcaacggcaaggtcagtgcgggcgagcgcattctgccagaaacgctgccggcaaatcctcatccggtactgaaagagttctttgactactatcgcatgccgcgcggcttccacgaacgttccgttaactctaccggggcgtggacggcaacgatgccgctgtcatttatgaatatgccgctgttgagctacgccagtgaaatcaccattccgacgctgattgtgaccggtgagaaagcacattcacgctattttgctgaagatgcttacaaggcggttggcagtaaagacaaagagttggtggtggtaccaggggcaaatcacgtggacctgtacgataacgtggccggaaaaatacctttcgcgaagttcgaacaatttttccagaccaaactgaaataaaacctcccctgaattgatgcaaagccaccggtctatggccggtggcttttatcctgatctttgtgaaatttcactatgtcgacactaagccaaacaccatcacctcatcatcagcacgcatactggggcggtatttttgccatgaccctgtgcgtgtttgtgctgattgcttctgaatttatgcccgtcagcctgctcacgccgattgcccgtgacctgggcgtgacggaggggctggcagggcgggggattgctatctccggtgcgctggcggttctgaccagcctgacgctttcaacgctagctggaaagatgaatcgtaagttcctgctgctggggatgacggttctgatggccgtatcggggcttattattgcgctggctaccagttatctgatgtatatggtcggtcgtgcgatgattggtgtggccattggcggattctggtcgatgtcagcggcaacggcgattcgtctggtgccgcagcatcaggtcacgcgtgcgctggcgattttcaacgccggtaatgcgctggcgacggtcgtggccgcgccgctgggaagctatctgggggctacggtcggatggcgaggcgctttcttgtgcttggtgcccatggcggttgtcgcctttatctggcagtgcattagtctgcccagcatggatgcgaataaaagccacacgtcatgtggcgcggtattccgcttatttaaccgccgcatggttgtggtcggcatgatagcttctggcctgtttttcatggggcagtttgcgctattcacctatgtgcgcccatttctggagtcggtgacacgggttaattccttaggcttgtcgttgattttgctgattatcggcgtggccggttttattggcacgctggttgtttcgatatttctcaacagaaaatgctaccccacgctgatggccatacccggactgatggccgtcattgccatcggtctgatgcttaccgggcatcacgtctggatggtctcgctgctgttaggactctggggcatgctggccaccgccgcgccaaccggatggtggacatggattgcgcgtacgttgcctgacaacgccgaagccggaggcgggctcatggtcgcggtgattcagctctcaatcgcccttggatcaacggcaggaggcatcgtgtttgaccgccttggctggcagagtacgtttgccatgagtagtgtgctgctcctttgcgcgggcgtactgacctttgttacagcacgccagaaggccggtgcgctttagtccggcgagggcgcgcgttgctgaaaaagttacacaaggcgatgagcaaccactatgggtagggcgctcttttaaacgatttaggtgattttctaaaacggctactgcaaatttttctcttaatttat

SEQ ID NO: 16 - DNA  (genomic), 2450 bp; double-stranded, linear
gtaagcgtacatcctgaaccgtctggtcagaatctgacgaattagacaaagtggtgtccaccaaataagtagtgggaaccaaagtatcagatatgcagaaaaatgtgactcccggcaggcgaaaaggctgccctaattatcctcccgaatttaaacagcagctcgttgctgcctcctgtgaacccgggatatccatctcaaaacttgctcttgaaaatggcattaacgccaatctgttgttcaaatggcgacaacaatggcgcgagggaaagctgctattaccttcttcagagagcccccagctacttcctgtgactctcgatgcagctgccgaacagccagaatcgctcgcagaggacccggaaaccctcagtatcagctgtgaggtaacgttccggcacgggacgctccgcttcaatggcaatgtcagcgaaaagctcctgactctgctgatacaggaactgaagcgatgatcccgttaccttccgggaccaaaatttggctggttgccggtatcaccgatatgagaaatggcttcaacggcctggctgcgaaagtacaaacggcgctgaaagacgatcccatgtccggccatgttttcattttccggggccgcagcggcagtcaggttaaactgctgtggtccaccggtgacggactgtgcctcctgaccaaacggctggagcgtgggcgcttcgcctggccgtcagcccgtgatggcaaagtgttccttacgcaggcgcagctggcgatgctgctggaaggtatcgactggcgacagcctaagcggctgctgacctccctgaccatgctgtaaatctctttatcctggttgtcacagaataagcccggtaaaatacgggcttatgaacgacatctcttctgacgacatcttcctgctgaaacagcgcctggccgaacaggaagcgctgatccacgccctgcaggaaaagctgagcaaccgggagcgcgaaatagaccatctgcaggcgcagctggataaactccgccggatgaacttcggcagtcgttccgaaaaagtctcccgccgtatcgcacaaatggaagccgatctgaaccggcttcagaaagagagcgatacgctgactggtagggtgtatgacccggcagtacagcgtccgttgcgtcagacccgcacccgtaagccgttccctgaatcactaccccgtgacgaaaagcgactgttgcctgcggcgccgtgctgcccgaactgcggcggttcactgagctatctgggcgaggataccgccgaacagctggagttgatgcgtagcgccttccgggttatccggacggtacgggaaaaacatgcctgtactcagtgcgatgccatcgtgcaggcacctgcaccttcgcggcccatcgagcggggtatcgccggaccggggctgctggcccgcgtgctgacctcgaagtatgcagagcacaccccgctgtatcgccagtcagaaatatacggccggcaaggtgtggagctgaggcgttcactgctgtcgggctgggtggatgcatgctgccggctgctgtctccgctggaagaggcgcttcatggctatgtcatgactgacggcaaactccatgccgatgataccccggtccaggtactgctgccgggtaataagaagacgaagaccgggcggttgtgggcgtatgttcgtgatgaccgcaatgcagggtcagcgttggcacctgcagtgtggttcgcttacagcccggacagaaaaggcatccatccgcagactcatcttgcctgcttcagcggtgtgctgcaagcggatgcgtacgccgggttcaacgagctgtatcgcaatggtgggataacggaagctgcctgctgggctcatgcccgccgaaagatccacgatgtgcacgtccgcatcccgtcagcactgacggaagaagccctggagcagatcggtcagttgtacgccatagaggcggatataaggggaatgccggcagagcagcggcttgctgaacgtcagcgaaaaacgaaaccgttgttgaaatccctggaaagctggttgcgtgaaaagatgaagaccctgtcgcgacactcagagttggcgaaggcgttcgcgtacgcacttaaccagtggccggcactgacgtactatgcgaacgatggctgggtggaaatcgacaacaacatcgctgaaaatgccctgcgggcggtcagtctgggtcgtaaaaacttcctgttcttcggctctgatcatggtggtgagcggggagcgctactgtacagcctgatcgggacgtgcaaactgaatgacgtggatccagaaagctaccttcgccatgtgcttggcgtcatagcagactggccggtcaaccgggtcagcgaactgcttccgtggcgcatagcactgccagctgaataacacatccccgtcaatacggccctcgctgtacgcttacagtgattg

SEQ ID NO: 17 - DNA  (genomic), 4716 bp; double-stranded, linear
ggattaagggttgtttgaatttcatggcctctacctgattcagctaaagtcacccattctggatttatcaccagccctttaccgatcgcaacaagtggcaggccagtggaaattgcttcttgagcctgagacggtgtgcgtattttacctgcagcgattaccggcactctgcctgcaatatgatttaaaatcaattcaatagttcgggggccatttggcgactcaacagggtagctatcgttaatactgaccagcgaggtatgtatatacgaaataccggatgaaatgagccgatcaaggagtttataagtatcctctatccgcagcccccctgttgcagattcttcaggagatattctgtaaccgatggcaaagggctttgtcgcatattcatagactacattttttacttcctgtaatacggccagcgggaagcgcatacgtccttcgagatctcctccccatcggtcattacgctggttaaatagaggggagaaaaaattctgtagaaggaatccgtgcgcaccatgaagttcaatgccatcaaaacctgctttaatcgccctttttgtgacatctccgaatgctctaatggtttcctgaatttcgttttcagtcatttccctgctttgtaccactctcttcataaagtcaccagattttacgcttgatgcgctggcactaataacatcgttatttggtacaagctccgggatggctttattaccggcgtggaaaatctgcaaaatagccggagcaccgccacttttggctgccgctgctaacttttcaaggctgttaatgaaacggtcgtcatacgcggcaaattcatgagtaaacccaatgccgcttggcgtgacataggtacatcctgttattactaaaccaacattttgtgagcgacgtttataaaattcgagttcttgctcagagatggttccatcaggattcgctgaccaggtcgtcataggagccataacgatacgattacgtagctttattttttctgtcagcataaaaggagaaaacaatgatgggtgtttatttgtcataacaatacctcaaatgtttatctgattttgatgcgtatgttttaactggttagttgttgccagctttggaaccaagagttctggctttatttataatccctttaaagggtttctaataattgagttgctgcttttttgttttttaatgaaatttctttttgaataattttattattgttgtgtagtcaataaaggataaatgtcagggagataagggatctccctgtaaaattattacaaatgtgttttataaaaaggaattaatttatcgagtgcctgtttcacaggttctggcttatcatacaggtcgtaatgtgaataaccttcaaccacgaccagctctttatgttttgaagcagcgcggccaataatttcgcagccgtcacggtaggcaccaaatgcgcccactctatcgcccaccacaaccattattggttgagttaacagcacttctgcaagatgaaatgcatcccaacccacggcaacagtctgatgtgagaatagcgaacgatttaccccattaggtgcatagcctcgtggcgaacgataatattctgtggcttcaaaaaggtctatttctgttagtcccgcttcaagagctgcatccggagaagaggggagtaaatcatctacgcgaagttttgcgccgttagcttcgtctgttctttgttgcgccattgcttcaagtgctccgataggattaaacgctgtaaatccctcacgcataagacgcccgtagtttgcacccgtgacagtaccaatagctttaattcggcgttctgtcattgcggcattaatggcatatccacctccaccacaaatacccagtacaccaatacgcccggcatcaacgtaaggtaagctggtaaggtaatcaacgacaatgctgaagtcttttactcgcattgttggatcttccagataacgcggttccccaccgctgcttccctgaaaactagcatcaaaagcaatgacgataaagccagcttttgccagggcggcaccatacacactacccgatgtctgttctttgcagcttccaattggatgggcgctgataatggcaggatactttttttcactattaaaatcgtcagggaaatagatatcagcagctatatcccagtaagtgtgttttatcgaaacagttttcatttcaagctccggggatttgcctaaacagatttaaatatcatttctattatccgcaactggcatttgtgttcatatcgagaacggcgtaatagtatgacttgtattggttatcatcaatggtctaatatctatcacagtgttaagttaaggtttacaatgatgaaaatagagccttcaattttgccttctcttgcctggtttgcgctgattgttcgtgccggcagtttttccagagccgtttctgaaatgggtattacgctggccgcattgtcccagaatttaaaatctcttgaggaacgtcttaacaccaagctgatataccgtacgacccgcaatatctcgcttactgaggaaggacagcgtctgtatgaagtgctggtgtcggctttggggcaaattgatgatgctttgaaagatgttggtgatacccaacttgaacctacaggcctgttgagaataaattcctcccgtgttgcagcacggatgcttgttgagcctcatattggcgagtttcttactcgttaccccaaaacaaagatagaactcattatggatgacggtttatctaacattattgcggacggctgtgatgtgggcatacgtcttgagcaaggactggatgagcatatgactgccgttcctgtttctccgcttattaaactggttactgtggcatcgccagattatttaaaagaacacggtattcctgaaacgcctcaggaactgagtaaccataattgccttcggttgcggcataaaagtagcggtgcactctctgcatgggagttttctaaggttgtggggggtaatgaagagttcgaaatagaggtttcaggtaagtatatttctaatgatgacgaaagcatgatacgaatggcgctgaatggaacgggtatcattcaacatctggattttgcaatcgctgaacatatcaatgcgggcaagttacagccgattcttgaggattgggctgtttcatttcctgggttttatatttatgtttcatcacgggtgagaatgccctctaaagttcgtgcttttattgattttatggtggagaaaagagtaaaactcgaaaattgatgatatgtgtaattgatggttgctctgggcgaatatcggtaagaggaataacgtaatcattaggatgcgtttacataataaagtttctgataattaatacttattttctatacggccataatatcaattatcattatcaccagtaatgtggttaaaataatagtatctatgaccgctacggttaacggtggttattttgggaggcgttaacacgtagcggcttgtagttgtaagtcttgaacaggtacaaagcctgaaatcaggaggatatcgctatcaaacttcctttatttcttctcgcagtttcgcatcttatagaagaatcctgtatttccatcttccacgatgaagcgatcgttaaaagttggacgacgaataaatgtcactccacctattgttgctttttgttttataccatcatcaacattttccagatctggagagtacaattgatctccatttggcatttgaacgatgaaattgtttccattatcgagaactgttgcggattttgacagaatttgagtagcggtatccaggctggaaatcctaatgtcacaaacatatttgcctggccccagatcttcttctgcaaatacaggtaaggaaaataatgcaaatgcgaggatgagattcttattcatgcaaactccaggaagatcaataaaagcaatatgttacataaaaagcacgtaaatgaaaagagcgattggttaatgagtaatgctattaatccccgcatggcctacttttcattggctgcggtgttgaacctcattgaatatgggcaagactctgactgagtgaccgacgtaaataggtagatgcataatcgcttaccgccctgtaactgcaaacggtgcccaggcttctggctgaataccacggctttgcatccacggaacggcgtgtagctgctgattgaaagggttaacttcaacctggtttaccgctggaacgacgttattaaaggcgataaggtcagccagtcggtcaggatggaagttactgacgccaatagcgcgaattttaccggcctgttgcagctcttccatggcacgccaggcaccgtggacatcaccgtaaggctgatgaatcaaatacaggtcaacgtaatcaagttgcagtcgattcagagagcgttcgaactgggctttggccccttcgtaactggtatcctgcaaccagagtttcgtggtgacaaagagttcgttacgggcgataccgctttgtttcagtgcgttcccgacctggggttcattttgataggaggcggcggtgtcaatcagtcgataaccggtgttaatagcgtcaatgaccgctctttcgcattcggcggcatcggtcatctgaaatacaccaaagcccagcaggggcatttcaataccgttattcagttttactttttgcatggtgttatccttcc

SEQ ID NO: 18 - DNA  (genomic), 3695 bp; double-stranded, linear
ctgacactgagcgccgggcataagcagggcaagagcggtgagaatgacactcgctttggcctggaagttaactaccgaattggcgaacctttggcgaaacaactcgatacggatagcattcgcgagcgtcgggtactggcaggcagccgctatgacctggttgagcgtaataacaacatcgttcttgagtaccgcaaatctgaagtgatccgtattgctctgcctgagcgtattgaaggtaagggcggtcagacactttccctggggcttgtggtcagcaaagcaactcacggactgaaaaatgtgcagtgggaagcgccgtcattactggctgaaggtggcaaaattaccggtcagggtagtcagtggcaagtaacgctcccggcttatcgtccaggcaaagacaattattatgcgatttcagcagttgcctacgataacaaaggcaatacctcaaaacgcgtgcagacagaggtggtcattaccggagctggtatgagcgccgatcgcacggcgttaacgcttgacggtcagagccgtattcaaatgcttgctaacggtaatgagcaaaaaccgctggtgctgtctctgcgcgacgccgagggccagccagtcacgggcatgaaagatcagatcaagactgaactaactttcaaaccggctggaaatattgtgactcgttccctgaaggccactaaatcacaggcaaagccaacactgggtgagttcaccgaaactgaagcaggggtgtatcagtctgtctttactaccggaacgcagtcaggtgaggcaacgattactgttagcgttgatggcatgagcaaaaccgtcactgcagaactgcgggccacgatgatggatgtggcaaactccaccctgagcgctaacgagccgtcaggtgacgtggttgctgatggtcagcaagcctatacgttgacgttgactgcggtggactccgagggtaatccggtgacgggagaagccagccgcttgcgatttgttccgcaagacactaatggtgtaaccgttggtgccatttcggaaataaaaccaggcgtttacagcgccgcggtttcttcgacccgtgccggaaacgttgttgtgcgtgctttcagcgagcagtatcagctgggcacattacaacaaacgctgaagtttgttgccgggccgcttgatgcagcacattcgtccatcaccctgaatcctgataaaccggtggttggggggacagttacggcaatctggacggtaaaagatgcctatgacaaccctgtgaccagcctcacgccggaagcgccgtcattagcgggtgccgctgctgaaggttctacggcatcgggctggacaaataatggtgatgggacgtggactgcgcagattactctcggctctacggcgggtgaattagaagttatgccgaagctaaatggacagaatgcggcagcaaatgcggcaaaagtaaccgtggtggctgatgcgttatcttcaaaccagtcgaaagtctctgtcgcagaagatcacgtaaaagccggcgaaagcacaaccgtgacgctggtggcgaaagatgcgcatggcaacgctatcagtggtcttgcgttgtcggcaagtttgacggggaccgcctctgaaggggcgaccgtttccagttggaccgaaaaaggtaacggttcctatgttgctacgttgactacaggtggaaagacgggcgagcttcgcgtcatgcctctcttcaacggccagccagcagccaccgaagccgcgcagttgacggtcatcgccggagagatgtcatcagcgaactctacgcttgttgcggacaataaggctccgaccgtcaaaacgacgacggaactcaccttcaccgtgaaggatgcgtacgggaacccggtcaccgggctgaagccagatgcaccagtgtttagcggtgccgccagcacggggagtgagcgtccttcagcaggaaactggacagagaaaggtaatggggtctacgtgtcgaccttaacgctgggatctgccgcgggtcagttgtctgtgatgccgcgagtgaacggccaaaatgccgttgctcagccactggtgctgaacgttgcaggtgacgcatctaaggctgagattcgtgatatgacagtgaaggttaataaccaactggctaatggacagtctgctaaccagataaccctgaccgttgtggacacctatggtaacccgttgcaggggcaggaagttacgctgactttaccgcagggtgtgaccagcaagacggggaatacagtaacaactaatgcggcaggtaaagcggacattgagcttatgtcaacggttgcgggagaacacaatatttccgcttcggtgaatggtgctcagaagacggtcacggtgaaattcaacgcggatgccagcaccggtcaggcaaacctgcaggtagacgccgctgctcaaaaagtggcaaacggcaaagatgcctttacgctgacggcgaacgttgaggataaaaatggtaaccctgttccagggagcctggtgacctttaatctgccccggggtgtcaagccgcttacaggcgataatgtctgggtgaaagccaacgatgaggggaaagcagagttgcaggtggtttcagtgactgccggaacgtatgagatcacggcatcggcagggaatagccagccttcgaatacgcagactataacgtttgtagccgataaggctaccgcaaccgtctccggtattgaggtgattggcaactatgcactggcggacggcaatgccaaacagacgtataaagttacggtgactgatgccaataacaacctgttgaaagatagcgaagtgacgctgactgccagcccggcaaatttagttctgactcccaatgggacggcgaaaactaatgagcaaggacaggctattttcaccgccacgaccactgtcgcagcgaaatatacactcacggcgaaagtgagtcaggccgacggtcaggaatcgacgaaaactgccgaatctaaattcgtcgcggatgatacaaatgcagtactcaccgcatcatctgatgtgacttctctggtggcggatgggatatcgactgcgaagctggaggtgacactgatgtcggcaaataaccccgttggggggaatatgtgggtcgacattaagacgccagaaggggtgacggagaaggattatcagttcctgccgtcgaaaaatgaccatttcgtgagcggaaaaatcacgcgtacatttagtaccagcaagcctggtgtctatacgttcacatttaacgccctgacgtatggcgggtacgaaatgaagccagtgacggtgaccattaccgcggtggatgccgatacggcaaagggcgaggaggcgatgaactaatattaagaatatggaagtaacattctaataaacaataatggcgttgacatcttcaacgccattatttattgaattgcctgacagtagtctcgttataagttcatttagatatagcgacagctaaaccggacgaacagggataaatatttcgcaaacaacatcattgctatccttttctacgaaatcttcattgtaataaaaccgctcaatatcactgccgttcactctggctaaccccctggcgggtaattccatcagatagaggtttcgcgcccattcagggtagtgctcccactcaccttcatagcggaaagagg

SEQ ID NO: 19 - DNA  (genomic), 589 bp; double-stranded, linear
taagtaacaatctgaaaatgccgatgatgggatttggtgtttttcaggttaccgataaaaacgtgtgcaaacagtcagtgttgaacgctatccgcacggggtatcgactcatcgacactgcagcggtatacggtaatgaagatgccgtcggtgaagccgttcgtgaagctatatccgaaggtttatgtacccgagaagagttatttataacgtctaaattgtgggtgcaggatatgttgaatcaggatacggcagcagcaggtattgaagcatcattaaaaaaatcgggactagaatacttcgacctctatttattgcatcaggctatgcgcgattatttcagtgcgtggcgtgcactcgaagatgcctatgaagagggcaaattaaaagcgattggggtttccaatttctatcctcatgttctggcgaacttttgtgaaacggtaagagttaaaccgatggtcaaccaggtcgagttgcatccctattttgcccaaccagaggcgctggcaaccatgaagtattataacgtgcagcctgaagcatgggctccgttaggtggtggacgacataaaccctttgaaaataa

SEQ ID NO: 20 - DNA  (genomic), 100 bp; double-stranded, linear
agtcattctgcgttggaatattcaacggggagtggtcgttattccgaaatcgacacatcaacagcgtatcgaagaaaattttgctatctgggatttctca

SEQ ID NO: 21 - DNA  (genomic), 4998 bp; double-stranded, linear
ttatagcctgcaggcagcatactgctgcctgcagggggtataacagtcgacaggggaaccgactgctttattcttaccaggtcacattgataccaactacaccctgtagcggattctcaatgtcgtcacctttggtgtagtcaaggcttgcatatgctcccatgtttttggtgatatcagcctgtacacctgcacccacgcggaatgctgcaccgtcaatgctggcattgacagactcatcacccagacggagccagagcatcaacagttgaggatcccgtaacattccagacagactcgttttgcagagatacactggcatttcctgcccctgaaactttgcctttccagactgaactatcggaaagatttatatccagattactacccgctttatcgccgctattgaaagtataagcattaccttcccagtaagagcgggcaacgttcatgtttacatttgttgtggtagcggctgaattctcgctttcagaaagggccaggacatcagagtagatggttgaatcagcaacagacaaatttaaattttgcgttgctgaacctgtgccttgtgccgaagcagaggcataaattgtttgtttattattagccgccccaattactgagccatccttaatattcaggttgactgtatgaattcccgtcttattcccggcagtaactattgtttcaatccgaccattaataatatttgagccagcaagggtaatgttgtcggttgcatcaccttcaaaactattcaataagctacccttttgagcaaaaattgccgtggaggcgttgctggaactcttattaccttgagcatttatggttgtgccattaagcgtgacattatttcccttggccccttccagagatatccctgtcgcactacctttttcattttttgcaacgaaattaccgccattaacaacaacatcgccagttgaatcaatgaccattgcagtccggacataggtgccttcaccttgagctgtgatggtggagtctgtagcattaatcacaacatttttgttaccactaacttttacaccttcaacgaattttttgtctgccgttgattcagcagtaatatcatgaccagcaaaagcaacattaaggtcttcatctgccgcattaattgttacggctgtaatctgtttgtctgctgtattgctaataacaacatcttgatccagagtcgtcttatctttattcagcgtaaccgaatcagttgataccgcgttatcagcagcgaatgctggtgcagaaagagccataacaatagctgtcgctaatgcgctgcggtaaaatgccttactgtttttcatgaagaaattctccattctggtaactaatttcaatttcccacttatttatatttatgcagagataaaacctgcgtccctgcatttaccaccacggaatacctgttggtatttccgttttcacgcaatgtcatggcattcgttttttccaatgcatttccatcaccgtgaaatttattgctgctcagcagcagggcttcccgcaatgacatgctgtccggtattccccaacgcttttttagcgactgctcggcaagccatatctgtcttatccccgttttgagaaactgcgcactgtattcccagctgtgtccggcaagaagcaacgacaacaccttcttttgcttttccgggaagcgttctgacatgacgattgtctttgtgcggttattcacctctttcataaagacagagtaactgtccataactggcaaattttctgcatgtttcagccctgataacccaccagaggaatttgcaatactgatgacatgctctactgacattcctggtttcagtaacctcaggtttttgagaacgccagaaatactcacatccggtggcagaaaaaatggcgcgacgcacaacaccaccacgaatgagtgatcccgataaaatcggaaccacatttcagcgcattcggcaggtcgccctgccgatatcacgacactctgtggcctgtgccgcaatttattgcgtaactcctcttctgttccgatgcaggtaacattgccgacagaaccggttgatagagctgcgaactgcgctggtacaattcctgagggacagaaaagaacgaaacgcatccttccctcacagatgtcagtacgccagcacgctgtacaggctgtacagcgtgcctcccaatcctgcagcccagagcagtagaaatattttggcccctacactgtagcgagtccgtacgcgccgcagtggggggtagtaacaacgctgttgtgtcataacaatcctggtctttttttagaaatattttttctttgtccgggaagtacttttccggaaatggcgtcagaatttattgattcaccaacggcaactttctctggataaagaattccggataccatgttctgcacatactgagtgagtcgatgagcggaatgttgtccgacatatcttgcatgtagccgtatattccgtttcactctgctgtcaccgcatcccgtatagagcagcctgaaatcgctcagagttcccagtccaagtttcattaatgcccgtgtggcaatcgcatgcagggtctttgaactgcgttgttcataacgggcaatctcactgaaactcatgccctgcatcagaatcttaagcacgctcaactcccgtgcagtcaggagccagaaatcgctcatatcgccgggcaaaggacgtagtaaccagcggataatttgattctgataacgactcgctgtcagcatggtgccgatgcgtgggaagccgttatacagacttgcagcaggagcattatcgaaccagtcggagtcaccggtcaggcagacctgccattgcccggcatcactccgcaagcggacaagacaagccagaagaactaactcccccgaaggaagctaagggatatcagccaacagatagccacaggaggtctttaaaacgaattcaacctctgtagtgacgttgctgtacacccgcacgatatacctgtccgctgggatgagagactccagtgccagcctggtaaactgacaggcactgataataaccagaggcttcttcattcagactcgtccacgccatagctacaaaacctgacattttgattcaaaatgtcaggttttgtttaattgcctgaatatttaattttcttggaatataaatctaatttgtttgatttttattgtttttaatttggttgcatttaacaacatgagtgaaagttaatcactggtatgaccttggcggttaatcatttcaaatcatggggttattttactttagcgagaaatatcaacatgttatgtgttttattgaattgaatgggctgtttttttatggaagaattgaggaaaacgtaggaatctgacattttgaatcagaaggtactgttttaacgaggcttttttttccacacccctttaaatcgagcagcattactggctgtgtatctgacagtatgctggatatttcgatgacccagataatcctgaagtagtcgggtatcgacaccattgtcagccagagcaaaaccacaggcatgacgtaacatatgaggatgtgcttttacagctaatcctgcacgtcttccagcctcacgaatgatagaaaaaaatgttgtctgctgatagggcggcgtttccgggagagaaaaagccagtctccttcaactccgttttcaattaacttcctctgcttaagccacaacttgatcaaattatattcatcaggaagaagaggatgtgttgtcgagaaaccatttttaatccgccgaatattaagttgttttcctgatgcatcaatatcggataaacgtaaatcaagaagttcactggccctaaaaccgtgaatgaaagccatcataattagacagcgatttctttcaggaaaggacatgctctgggctgcatccatcagcctgtagacttcatcctgtgtgagatattttctcgtcatacgccaccgtgtacagttgtaaaaaagagaggcacacccagataagtatgcctgcaatcagaacgttatcgatgtaatctcattatctcattaataagattttttgaatagtagttctacgcaatagactaaatatgaactatttattgtgctgcttttctacaagccatttttaatgcgtgtttttatctacattgatgtgaaaaaataaatataaaagctatgaattacagggcgtgggggatgtgtgttacgtctaatgttttagtgatgtttagtagttttgagatatttgatgttatttcttataaggttgtttttattgtttatcttattgattttatatgcattttgtcgttcaatgaagttattgtgtagaaaataaaaatttaatattattcccgttaatttacaataacacattgttgtaagatattttttagtcgtaagtaaatcattattgatgggttctgctaataaattaaagattttctcttaaatagtttttttgcttttttgtaaatatcaatttgtttatttttgattcatttgctggagagtatttcaacaatttttatttttttgcataaacttattaacaactttttattgtcaattggaaatcaatgtaaactaaaatgttagcgaagcgataaccttgtactaaaaaatatttaagcatgatgattaattaaagaagagtaaaaataaatcactgctaataaattatacgaattgtgtttaaagctccacgttgttttggtctgacttatttttgtcctcgttacaagaacccttttcgtatatgctaaccgtgagcgggagtgaacaagtcaccatagccaggaacactagcggcgtaattcttaagctgagtggcatttcacctgcggtttatcagtgcattcatagtaccttcatcagcgagattgaacgagtcagcttagaatttgctggcgaggttgtcactatgaagcatgagagttacccctatgttttatataacgattctgtccccata

SEQ ID NO: 22 - DNA  (genomic), 4643 bp; double-stranded, linear
gggaatcattgactcgctgtaaaaaattatgcatatattatatatgattgtcatgtcatatcctgaaattcctcttgtatcacttcatgattttatattttattaattaacgattttattttgtattagctgaatggattcagtcctatagggttatatatttattaataagacgattcttatatttggatacctaataagagttaccacttttaccggctgtatattaaatgtatttctcctgcttttgtttatattttgagttgatttgagttcccggatacatataatgcgcaggtattagagactggggggaaatgtaatgataaagttaagagtgttaacttaaaataagtttttagtagtaacttgctattttattaccctctgaactacatactcagatatgtggttgccaatgctatgcaaaatttttgaatttttatatgcgatgaacagtaaccggaatggcatttaatgcgttgctgtttatgcaatcttggttttatttggatgtattgctggagattgtgatgaataaaatatatcggctaaagtggaacaggtcccgtaactgttggagcgtctgctcggagctggggagcagagtaaaaggaaaaaagtcccgggctgttttaattagcgcgataagtttatattcatctctggtattcgccgatgatgtcatcgtaaaccaggataaaactattgattttggcaaagagaaccagagcatcgattaccgtattacggtgacagacaatgccaatctggtaatcaatgcgacagatacttcccgtccgcgtctgactctcgcttctggtggtgggttggatattaccggaggaaaggtaacaatcaatggcccacttaactttttgctgaaaggtacggggttcctgaatgtctccaatgctggcagcgagttatatgctgatgatttgtatgaatcaaactcaggcatgagacacgatcgcggctattttaatgtctccaacggcggcaaaatccatgttaagggcaccagccgtctgacctatttgcagggaaatgtcagtggtgaaggtagccaggtaaattccgaaaccttctttatgggcgtttacggcagttacggtggtaatcagtacctgtcagttaataacggcggtgaagttaatgccaggaagcaaattagcctgggctattatgatcaagtctccgatacaacacttgctgtttcggaaggtggtaaaatttctgcgcctactattagtttaagcaccaactctgagttagcgttaggggcacaggaaggaagcgcagcgaaggcagcagggattattgatgccgaaaaaattgagtttgtgtgggcaaagacatccgagaagaaaatcaccttaaaccacacggataaagacgcgactatttccgcggatattgtcagtggcagcgagggcctgggctatatcaatgcgctcaatggcacgacttacttaaccggtgataactctgcctttagtggtaaagtcaaaattgagcaaaatggcgctttagggatcacccaaaatataggtacagcagagatcaacaaccgcgggaaattacacctgaaggctgacgatagcatgacctttgccaataagatctctggcaacggtacaataagtatcgacagtgggacggtggagttgaccggcaataactatgcattcagcggatatattgatgttgcttctggtgctgtcgctgttatttctgaagacaagaatatcggtcgtgcagagctggatgtcgatggcaaattgcaaattaatgccaacaaagattgggtatttgataacgatcttgaaggtagaggcattgttgaaataaacatggggaatcacgaattctccttcgatgagtttgcttatacagactggttccagggttcactggcgttccagaacacgacatttaatctggaaaagaatgctgagtttctgcagaaaggcgggatcactgcgggtcagggaagcctggtaacagtgggtaagggcgctcactccattagcactttgggattctccggcggaaccgttgattttggtgccctgacagcaggtgcacagatgacagaagggacggtcaacgttagtaaaacgctggatttgcgcggcgagggtgtgattcaggtttctgacagtgacgttgtccgctcagtatctcgtgatattgactctgcgttatcgctcactgaagtcgatgatggtaacagcaccattaagttggttgatgcgcaaggtgcggaagttctgggcgatgcgggcaatctgcaattgcaggataaaaatgggcaaatcctctccagcagcgcccaacgtgatattcagcagaatgggcaaaaagcggccgtcggcacttacgactatcgtctgacgagtggggtaaacaatgacggtctgtatattggttacggcctgacccagcttgatttacacgctaccgacagcgatgctctggtgctgagctctaacggtaaaagcgagaatgccgccgatctcagcgcaaagattaccggcagtggtgacctggcattcagcagccagaagggtcagaccgtatcgctttctaacaaagacaacgactataccggtgttaccgatctgcgcagtgggacgcttttgttgaataacgataacgtgttgggtaatacccatgaactgcgtctggcggcagagactgaactggacatgaatggtcacagccagaccgtgggcacgctcaatggcagcgccgattcactgctgagcttaaatggcggcagtctgacggttaccaacgggggcacttcaaccggttcgttaacggggagcggagagctgaatattcagggcggcacgctggacatcgcgggcgataacagcaacctgacggcgaatgtgaacattgctaattcggctaatgtcctggtaagtcatgcgcagggattgggtagcgcaaacgttgagaacaacggtaccctggcgttgaataatagcgctgaaaaaagagcggctgcgtctgtgaattacgccctgggcggcaatctgaccaacaacggtacgctgatgaccggaatgtcaggacagcaagctggcaatgtgttagtggtgaaggggaactaccacggtaataacggtcaactagtaatgaatacggtactgaatggcgatgactcagtaaccgataaattggttgtcgagggcgatactagcggcacgactgccgttacggtgaataacgctggcggtacaggtgcgaaaacccttaacggtatcgaacttatccatgtagacggtaagtctgagggcgaatttgttcaggctgggcgtatcgttgcgggggcgtatgactacactctcgcgcgtggacaaggggcaaatagtggtaactggtatctgaccagcggcagtgattctcctgaactgcagccggagccagacccgatgccgaatccagagccaaacccgaatccagagccgaaccctaacccgacacctacgccgggtccggatctgaatgtggataatgacctgcgaccggaggcgggtagctacattgcgaaccttgcagcagcgaataccatgttcaccacgcgtctgcatgagcgtctgggtaatacgtactataccgacatggtgacgggtgagcagaaacaaaccactatgtggatgcgccatgaaggtggtcataataaatggcgtgatggcagcggccagctgaaaacccaaagcaatcgctatgttctgcaactgggaggcgatgtcgcgcagtggagccaaaacggcagcgaccgctggcatgttggggtcatggcgggatatggcaacagcgacagcaaaaccatttcctcgcgaaccggttatcgtgcaaaagcgagtgtgaacggatatagcacaggcctctatgccacctggtatgccgatgacgagtcgcgtaatggcgcgtatctcgacagttgggcgcagtacagctggtttgataacacagtgaaaggggatgacttacaaagtgaatcctataaatcaaaaggatttaccgcttcactggaagctggatacaaacacaaattagctgaatttaatggcagccagggaacgcgtaatgaatggtatgttcagccgcaagcacaggttacctggatgggagtcaaagccgataagcaccgcgaaagcaacggaaccctcgttcatagcaacggtgatggcaatgttcaaacccgacttggcgtaaaaacctggctgaagagccaccataaaatggatgacggtaaatcccgcgagttccagccgtttgtagaagtgaactggctacataacagtaaggatttcagcaccagtatggatggcgtgtctgtcactcaggatggagcccgaaatattgctgagataaaaaccggggtggaaggacagctaaatgccaacctgaatgtctgggggaatgtgggcgttcaggttgccgataggggatataatgacacctctgcaatggttggcattaagtggcaattctgatctgaataatgagtaaaaggagagagagccgaacgggagataattcggctctctgtgtcattttcttgcagccagctttatccgtcagagtgaagactcgcagatttagctggcgcacaagattta

SEQ ID NO: 23 - DNA  (genomic), 94 bp; double-stranded, linear
atggcgcaagaatctgtaggcctgataagcgtagcgcatcaggcatttgtcaccattgccggatgcggcgtgaacgccttatccggcytacgaa

SEQ ID NO: 24 - DNA  (genomic), 93 bp; double-stranded, linear
tttgtcaccattgccggatgcggcgtgaacgccttatccggcctacgaatggcacgagaatttgtaggcctgataagcgtagcgcatcaggca

SEQ ID NO: 25 - DNA  (genomic), 598 bp; double-stranded, linear
gggaatggtttgctaatgaatgatcctgaactttataatctcccggcataatttccaggggattatttgagagaaatacacaaaagtgagttttaacaaaggtatttatcaggccataaatgtgacctgcttcggataaaaaagattcagtatcgaaaaaccaatgatactcttgctgatggttaccaacagtaattaagatgtgatttgtttttccgtaatcgcaaaaatattgccatgaccataaaagaaaaattctcacaaaaatatccccatgcttccttttgtacttttggcgattcagccgcgttggccgatcacctcgcaacgttgattgcgactggtgttaaaacagcttcctgtggttcgctggcgggatgtattgaagacaacgcatttccgatgattggtgagtataagattgtagaaaatagccgtggtgagcctgtatgtgttatcagagtgattggcctgcatttactgcgcttttctgatgtcaccgcggagcttgcccgtaaggaaggtgaaggtgacctcagtcttgaatattggcgtaatgaacaccgtcgttttttccaggcagaaggaagctattcac

SEQ ID NO: 26 - DNA  (genomic), 4588 bp; double-stranded, linear
taagctcacaaacataaaatatcgctaattttgtttattttgctgttttttacgtgatgaatgtcacacttattattgctgcccgttttgtccatatttataaccatatttttaatagctgcctgaaatagagctgtttattctgcataaaaatattcgaaaattcttattctctccagcgcgctaatttgggcgaacacttcctgactaccctgcaatgaggctgaaatgatgaataaacgttttgttatcaatatggtgtcttcgctgttattaggcgctgcgctaatttctgcgccgctccaggcagcggaaaaagtcgtggtgaatatttctaaagtcgatggtatgccgtggtttaatcgcatgggcgaaggtgtggttgaggcgggtaaagcctttggtgttaatgcctcacaggtggggccttcaagtactgatgctccgcaacaagttaaaattattgaggatttaatcgcccgtaaggttaatgcaattactatcgtgccaaacgatgccaacgtgctggaaccggtattcaaaaaagcgcgagatgccggaattgtggttctgaccaacgaatcccccggtcagccaagtgctaactgggatatcgaaatcattgataacgaaaaatttgccgctgaatatgttgagcatatggcgaaacgcatgggtggcaagggcggctatgtgatttacgtgggtagtttgaccgtgccgcagcataacttatgggctgacttgctggtgaaataccagaaagagcattacccggatatgcatgaagttacccgccgcatgccggttgccgagagtgtggatgtctcacgtcgtactacactggacctgatgaaaacctatcctgacttgaaagcggttgtctcctttggttcaaacggtccgattggcgcgggacgtgcggtgaaagagaaacgggcgaaaaataaagtcgcagtctatggcatgatgatcccttcacaggcggcatcactgattaaaagtggtgatatcaccgaagggattacttacgatccggcctctgcaggttacgcactcgcagccgtcgccagcacgttgctgaagggtgaagagatcaagcctggattagaaatgcagaatctgggtaaggccgacgtagatatggataagcgaattatccgtttccataaggtattactggtcaacaaagacaatatcgactcactttattaatccatttcttcggggcgaaagccccgattcttattgccaggggatgttatggaaaccttcctttcccttcgtcatatcaacaaaacgtttcatgccacgcgagcgctgcgcgatgtttctctcgactttatgtcgggtgaagtgcactgccttgccgggcaaaacggctgtggtaaatcgacgttgattaaaattatgtccggtgtttatcgcccggatgagggagcggaaattacgcttggtgggaaaaactggtcaaagctgacacccgccgcttcggtggcgcaggggattcaggtgatttattaggacctctctttatttcctaacctgagtgtctgggagaatatcgccgtgaatcactatcaccacggtctgtttgttaaccgccgtcgtctgcgtgaggtggcgcaggcggcaatgactagtattaacgtcacattgccactggatacgctcgtttctgagctttcaattgcccgctgtcagctggtggcaatttgccgtgcactggcgcaggacgcacggttgatcgtgatggatgaaccaaccgcttcgctgacccatcaggaagtgcaagggttattacaggtggtgcatcaattgcgtgaacgcgggatctgcgtggtctttgtcagtcatcgtctggaagaagtgatggaagtttccgaccgtatttcagtgctgaaagatggtgagctggtcgggacttttccggctgcagagatgaccacaaaacaactcggtttcctgatgaccggccaggagtttgaatatcaggtgcgagagttgtggcagggaaaatccagcaccccggtgctggaggtgcgtaatttaagtcgtcatggggaatatctaaatattaacttgcgggtggaagcgggcgaagtggtatcgattgttggcctgcttggtgcggggcgcacggaattatgtctgagtctgtttggtatgacccgaccagatgctggcgagatcctcatcaacggccagctggttacactgcatagtaaccaggacgccatccgccacggtattggttatgtttcggaagatcgcatgtcgcgcggtttggtgatggcgcaatctattgaagacaacatcattagcactgtttttcacaaggtaaaagatcgcttcggctttctgagtgaaactaaagtgcgtgacctggtggacaggctaatcaaggcattgaccatcaaagtctctgatcctcatcttccggtgaatacgctttctggtggtaacgcgcagcgagtatcgatcgccaaatggctggcgattgggccacgactgttgattctcgatagcccgacagtcggtgttgatatcgccaacaaagcaggaatatacggcattatcagcgatctggcggctcatggcattgcggtattgatgatctgcgatgaaattgaagaagcgtggtatcaaagccaccggattttggtaatgcaaaaaggtcagatcacccatagcttcctgcctgacagcagttctcaggccaggattgcggaggtggtaaatggctgaactgaaaaaacgccatgaattctggctggcattactgattgtggtgctgtttgttggccttgcctggcgcagcgacgaatttctgacattcggtaatttgtacgatctcgccaataactatgccatgttgactattctcgcctgtggtttgtttgtggtgttgatttccggtggaattgatatttcgtttccagcaatgaccatcattgcgcaatacggcatggtgctgttgctgcaaaaaattggtggcaacttcgctgtcgcgtttgcactggcaggctgcatcggcattttacttggcttaattaacgccttactggttaatcgcctacgggtgccttctatcatcatcactatctcgacgctgaatattttctatggcctgctgttatggttgagtaaaggtgtgtggctgtacgactttccgccgtggtttgagcagggggttatgttgttcaagtacaccgatgctgatggctatgactatggccttggtctgccgctgatcgccatgattacggtggtgctgctgacagcgtttatcatgaatttcaccagtgtagggcgcaaaatttatgcccttggcgggaaccgcgaatcagccagtcgcatcggctttagcgtgctgaaactgcaacttttcgtctacggctatatgggattgatgtctggcgctgcgggtgtagtgcagtcgtggacggtgatgactgtcgcccccgattctcttctgggttatgagctgacagtactggctgcggtggtgcttggcggcactagtttgctcggcgggcgcggcacgttaactggtactttgctcggcgtggtgttgttggcagtgatgcaaaacgggctaaatttattgggagtctcgtcttactggcaaacattgatcaccggcatcatcatcgttgccagcattagcgccacggcgtggagtcagcatcagaaccggagcctgctatgaaaaaatcgtggcgtaataacgttgagttttacttgatcggcctgctggtgctaactgttgccgcgttcagcattactatgccggagattttctggtcgataagtaatttccagtccgtcgcttcgcaaatgcccgtgctgggcattctggcgttggctatggcggtgaccatgctttgcggtggcattaacttgtcaattatagccactgctaacgcctgttcactggtgatggcgtgggtggcgactcagtatccaccgggtattgctacggttgtcgctacgttactggcgggcgctggcgcggcggtgataatcggtttatgtaacggcgtattgattgctggtattcgagtgttgccaattcttgcaacgcttgggatgatgacgttgctcaaagggataaatattctggtgacaggtggtagcgccattgccaattatccctcatgggtgctgtggttgaatcatgcgcaatggttcggtattccgctaccgatgtggttgtttgccgcagtggcactggggctgtggatattgctggagaaaacgccgctcggtaaagccatttacctgattgggtctaacgaacgagcaacactttactccggcattaacactcgtcgggtgctgatttgggtttatgtcatttccgccttgctttgtgcggtagcggcatttttgatgatgtcgaaactcaactcggctaaggcctcttatggcgaatcgtacttgctggtgtcaatcctcgcggcagtactcggcggggttaatccggacggcggcagcgggcggataattggtatggtgctggcgctgtttcttctgcaaattattgaaagcggcttcaatattctcggtataagcccctacctga

SEQ ID NO: 27 - DNA  (genomic), 565 bp; double-stranded, linear
cgcatccgacagttgtgcgcagatgcctgatgcgacgctggcgcgtcttatcatgcctacaggcctgaaccgtaggtcggataaggcgctcgcgccgcatccgacaccatgcgcagatgcctgatgcgacgctgatgcgtcttatcatgcctacaggcctgaaccgtaggtcggataaggcgctcgcaccgcattcgacaccatgcgccgatgcctgatgcgacgctgatgcgtcttatcatgcctacaggcctgaaccgtaggtcggataaggcgctcgcgccgcattcgacaccatgcgccgatgcctgatgcgacgcaggcgcgtcttatcatgcctacaggcctgaaccgtaggtcggataaggcgctcgcgccgcatccgacaccatgcgcagatgcctgatgcgacgctgatgcgtcttatcatgcctacaggcctgaaccgtaggtcggataaggcgctcgcaccgcatccgacaccgtgctcagtgcctgatgcgacgctgatgcgtcttatcatgcctacaggcctgaaccgtaggtcggataaggcgctcgcgcc

SEQ ID NO: 28 - DNA  (genomic), 1834 bp; double-stranded, linear
gcggggctgacgccgaagtgagatttaaaatgctgacgccaggtcacaggtgagagaaaacccacctcagccgctatccgctcaacgggcaactgactggatcccaacagttcctggctacggcgtaagcgttcagtaatgagccattcggcgatactcgaaccggtcgctttcataaaatggcgagttaatgtgcggcgactcatcattactcgctgcgccagcgagtcgagatcatgctgttgcgcaatgttttgccgcaggtaatccagcaggaggtttatgcgttcatcatgggtatttttcggcaccggttgctcaataaactgcgcctgaccgccggtgcgatatggcggtacgaccatccgtcgggcaatatggttagcatagtcgctgccaaaatgttgccgaacaatatacaaacagcaatccagcgccgcggcagtaccggcagaggtaataatgccgtcatcgtctacgtacaacgcgttaatatccagatgtgtttgtggaaaacgtgcctgaaattcacgctcgaactcccagtgcgtggcggcacgcttatttttcagtaaacctgcatagccgagcacaaacgtgcccaggcaaagcccgacaatctgtgcgccgttatcccgtgcggtcgttaaggcttccagcagtttttgtggcggtttttgtgtaatggttccccagtaaggaattatcacaatatctgcctggatgactgcggtatagtcatgggtggcggttacggaaaacccatcggcagagtccacgtttcccggcttttcagcgcaaataatcacgtgaaagcgttttttctccgccatcttttcactaaacacgataaacggtacggaaaggtgaaaaggactaaaaccggcaacggcgataatggcaacagttagcgggcgcataacactctttatctccgaattagaatgtcaacgtttcaccatcttctggtacgttcacaaattcgataatttgattatctctggcgtattccttgagcgcatcacgcgtcagcaaacagtggtttacggcctccatatgtgtcgcgataatttgcgcttctgggagggtaaaatgtgttttgagaatatcttctgctcccataattatcgcgccatgccccagaacatgcgcaaatccggcattcaacacaaccacttctggttggaaagttagcattgtagcctcgacgtcgtcacgccagagggtatcgccagccagatagagcgttttctctgtcgggtgctggaaaacaacgccgcaagctgcgcctaaacgcttcgccatcgccgggtcggcataggtgcgatcggagccgtgctgccctgtcgttttatgcagagtaatatcgccaaatttagtctcgtcggtaagtacggtaagatgcgtaaatccttgtttattcagtgattcagcatcttgctcattttgcacataaatcagtttatctttagggacgacgcgggaggctgtttcgccccagtgatcttcatgcaaatgggtcacgattagggcgtcaacgttgagtaacgttgttaaatcgcacggtaattctaccgttggattgcggatttctgcgcgtgccgttccggcaaaacccggataacttcctttaggcgcgagtaacgggtcgataagaaatgttttgccagcgtattggataatttgggtggcattacgaatttgcgtaattttcatgatttgctccacatcacagtattgatgtcattagcgtagcgtgcagcccgtactgtgcatgtgggcaaatgggcgaataacgatgagaatgggccaaattacacattggcgtaactag

SEQ ID NO: 29 - DNA  (genomic), 8114 bp; double-stranded, linear
aagcctaaccaggtgaacggtccctcaagacagatggggaccgtttatgtgctatttttatgccgcatccgctaaaacaaacatcccgtaaggatggatttcgaggtaatagtgctcaccaatatcgggctgtaaacgggtggcgtttacttgtaataaaatctcctgtccatgccactctacggtcacttcgtactgcggccccatgtaggcgacatggcgaataacacaacgctgactctcttcgccgtgattgcttaaggtgatggcttccgggcgaacgccgacggtgccgctaccttgcaccgggaaatgcgccgcgcgcggcaggcgataaccgtagatatcgacatactcttcgctaaagttcgccgggaacaggttggcgtcgcccataaaacttgccataaagcgggaggctggctgacgatagagatcctgcggtgagccaatctgcatgatgtgacctttattcatcaccagcacagtgtcggaaaccgcgaaggcctcactttgatcgtgagtcacgtagagcgacgtgatattaaactgcttttgcagctcgcggatcttatcgcgcatgctgcggcgcaggttggcatcgaggttacttaacggctcatcaaacagcagcacctttggtttgaggatcaacgcgcgggccagcgccacgcgctgttgctgaccaccggaaatctggtcgacatagcggtcctcgaacccttccagatccaccattgccagcgcctctttcacccgctgctttacttcgctacgcgacacgccgagcatctttaacccgtagccgacgttttcgcccagcgacatatgcgggaacagagcgtatgactgaaacaccatgcagatatcgcgctgctgaatggaacgatgcgtgacatcttcgccatcaataaagatttgcccttcactcggtttttccagcccggcaaccagacgcaaaatggtggttttgccgcagccggaagggccaagcagcgtcaccatttgcccttgtgggatggtgagattgatattgtcgataaccgtattactgccgaatcgtttagtgacgttgcgcagttccacaaaatttttctgactcatagtgcgctccattacgcctggtttttggctttagaacgggagatacgtgcttctccgatcagccagtcaaagaggaaaataatcgccagcatcaccacgatcagaatcgaaccataggcgatggctacgccatattcgccgtcttcaacgcggttaagaatgtaggcggttgccacgcgggtgtccggcgtgacgagaaagacgatggcgctgaccgtcgtgatggcccgcacaaagctgtagatcagggccgagagaatggccggacgcagcagcggcagtaaaatgtgggttatggttcgcaaggaacccgcgcgcaggctgagtgaggcttcatccagcgatttgtcgatctgccccaggcctgcaatcccggcgcgaatacccaccggaacgttacgcatcaccatcgagataatcacaattgccgccgttccggtgagataaaccggagcgctgttaaaggcaagaatatacgaaacgcccgccaccgtacccggtacggcaaagcacagcatggtggtgaactcgatggtctttttgcctttgaattgttgacgcaccaccacccaggcgatgagcaggccaaagatagcggtaatgggagcggcaatcccggcgtagagcagggtatccagcagtgaaggccacgcgccgtcgctcattccctgaccaaatagcttgataaagttatccagcgtcagggtgtagtccacgccccagttcaccgtgaagctgccgtagaaaatgctgccgtagagcagggcgttaaaggcaatccatatcgcaagtatggcgaccacgctccacaccagggtgaccggaagcggctggacgtcgccacggtaggatttgccggaaaccgtgacgtaagagcgtttaccaatccacatatactgtatgcagaacaccagcagcgagaacagcagcaggaaagcgccaagggtgctggcggcctgataatccagctgcgagccggtaatatagaagtaaatttgcgtcgccagtacgtcgaagttaccgccaagtaccagcgggttactgaaatcagccagtgactgtaccacgacgattaaaaaggcattggcgagcgcgggcttcaacaacggcacaaacacgccgttaaaggtttgccagcggctggcgcgcagggtgtaggaggcctcttccagcgagggatgaatggttttaatggccccgtcgaggatcataaatgccattggcgtgaatgccagaacctgtgccagccagatcccggtaaaaccgtacagccagttggtgttggtcagcccaaaccactccaccataaattccgtaacatagccggaacgccccatcatgagcgtcacgcctaagccgaccacaaacggtggcgtaacgatgggcaaaatggaaaagatgcgaccaataatggcgctgcgtttagcgatgcgcgtggtataaatcgccagcaccaggccgaagaaagcacagcctatccccaccgctatcgacaagacgatagagttgacgatcacctgaacaatatgtgcctgcgagagcacggtcataaacgccagcggggcgagctctcccgcgtcgttggtgaacatcgggataaaaatggcgatgctcggccagacgataaaaatgccaatcagcgccacaatcgcaatcagtgagccgatcacgaagcggtcgccgcccagccattcgaggcgggttaaggccagcgtcataatcgcgcctagttcgacaaacagcacgatggcggcgtagcctaaaccgcgtccagccacggtggcgctgatgacgataaacgccatacagagcaatgcccagccggcatcgaaataatgacgactacgctgttcgcgcgtggcctgacgaaacgggcggaccagcaacaggctcgggagtaaataccacagccagctgatattaaaatgcgaccagccgtacgccccgaggatctcatcactcgtggattccagcaggccataatcgaggctccagctcggcaacaggacaaatgccagccagcccagcaaaacccaaaggaaaatcgcatcccgctttttcacgggatggagtgcaagtgtctgtgacatagcagttccggtatggttggccggggcaggcgtctgcgctgcacccggcaaatgcgcctaatgcgggtttatttacccatcttcacttcgctgacccatttattaatcaatgccttacgaacatccgtggaaccatatttatccatgtcgtagttgattaatttcaggtcgtcgagcttcagcgaatttggcgacgtttcggcggtggtattagtcaggatctgataagacttccctttcttccacgccagttcctgagcttcttttgataatacccagtccacaaacagtttggcgttgtcgaggttgcgcgcgcctttcagaatgctgacgccgccaatttcgtagcccgtaccttcacacggggaaatcaactccagcggcgcgccctgttctttttccagcgagtagtcatgcaggaagccaataccaatcgccgtttcgccacgggcggcgttacgtgccggggctatgcctgatttggtgtactgagagacgttggcgttcagttgttttagataatcaaaggcctgatcttccccccacagctgcgcaaaagtagccagggcggtgtaggcagtaccggaactttgcggatcggcaatttgaatttcgcctttatattccggtttggtgagatctttccagcacttcggcaccggcaggtttttctctttcagacgatcggtgtttacgccaaaaccgaggatccccacataaacggcagaggacagattccctttcacttttgccggatcgcggaatttctccatgatctgctcaaggttaggggatttatacgcctgtagcaggcccatctcgccagcctgcgattgcgggtctaaagtgccgccgtaccagacgtcagcctgggggtttttcttttcagcatcgacttttgccagggtgcttccggaaccgttgcggataaacgaggtttttacatcatatttctcgccaaacgctttggtttcggcctcacacatttcattggtggcgctgcaatagaccaccagccggccttttgcctgcgcggcacccgttaaagtcgccagcgcaacggcagaagcaatcagagtagaggtaaaggtcattttcattgttttatccttcgagcgtgagtggtggtgatgcccgccatcagtaacggcatcagcagtaaacccataagtactgcggcgaccgagagtaaactgaacattcccggccagccgtagcgttcgatgaccagcgacagcggccagcctgccagcgccgcgccaaggtaagcgaacaggccgagaaatccggtgattgaacccgccgcagctttgtgcccacactccaccgccgcaagtccaatcagcatttgtgggccaaagacgaaaaagcccacggtaaaaaagcacactgccagcagagcgtagtgatgaaccggtgccagccacagtgcggcgactgacaccatcaaccccaacgtgaacagcaaaatcattggcgctcgttgcccgctaaacagcaaatccgatccccatccggcaaataacgcgccgagtaagccgcccacttcaaacagcattaccgtggcgttggcgctgagcaggttgacaccgtggctttccgtcagccagatattgccccagtcgttaagcgcaatccggatcacataaaccagtacatatgagacgcccagtagccagatcagcggattttgcagcatggtggtgcgcaacatttgccacagccccatcggcggactttgttgttcctgacgtaactccagcggatcgtgacgccagtgaccaactgtcggtaatccctcttcctggggcgtgcctttgagttgtagcgttaaccagatccctaatgccatgctgattatccccggtgtcagcatcgcggcctgccagccccaccagtgggcggcaaaggcgctaatcagcggaataatcgctccgccaatgttgatcgacatattccagcagccccaccagaaaccgcgctcattgcgtgagtaccagtgggtcagcaagcgggcacacggtggccatccccagccctgaaaaaaaccgttcagtgtccagaccacaagcagaagcgtaagtgattcgccaaaggcaaacaccacgttcaataacccggtggcgaacaagccgacgcccataaaaccgcgttgtccgtggctgtcatgccacagtccggcggtaaatttcgacaatccgtagctgagataaaacagcgaacccagcaggccaatgtcgcctttatccagtccgaggtcggtttgtagcgccggaaggacgtaattcacgctttttcgcgtcagataaaatgcggcgtagccaataatcatgcacatcagcaatcgcggacgtaatgtccggtagcattgattaatttctctcgctgaacgcgcgtgcatggttgtctccatgttgctgactatatgaaaatgaaagtgaaaggggatgagagaaaatccgggatacctaagactttttcctggttatccggcgatttgttgcaaaaatgtgggcaagttaacaattacccgcgtgccgtgctgtttttcgagcgttaagtcgccgcccagggcgctgacgcgctcacgcatcccctgaatgccaaatccagccattttcccgctggcgatccccacaccgttgtcgctgacttccagatgcaatacctctccctgctggcgcaggataatcgtcacttcgctggcttcggcgtgtttacagatgttattgagcaactcctgcaataaccgatacaaggtaaagcgcaccgtttcgttttctggtgtggagttcagttgataggcaaactggcaatgaatgccgcgttcactaaaggcaaattcattaatcagatgcagcaacgcttcgcgaaatgtcagttcatcaagcgcgggaggccgcaactggcgcagcaattggcgggtggagagatgaatgcggcgggcgagctcattgatttggctggctgcggattgaatttgcgccggatcacgcgcccgcttcaccagttgcgactggatctgaatggcggtgatgttctgaccgatttcgtcgtgcagctctcgcgccaggttttttcgcgtgtcctcctcggtgtggatcagcttttccgccaatgcccgccgcgctgccagctcggcctccagccgttgtcggtaatggtgcaggtttagcgccagatgttgctggcgactgatggcaatgcccaggccaattcccagcaaggcctgggtcgcgaggaaaatctccagctccaccaggttactaaagcccacgccaatctggcgggcgatggtgatcatcatgctgcccaaaagcccggagagtacgccaccttgccagccaaatttccacgccatcaccacattgggcaaaaagaccacgatcaacagcagacgttcaatttcaggtgacagcaccatctgagtgccgataccaataataaaaaacaggctacaccagatgattaaagaggtacgcaaggggggattatgcgtatcgagtcccaggagctggtagcgatgctgctggcgcagaaactcaaagataagatagacaaacggcgtcagtaatacgccgccggtaaatgaggtcaaacccggtagcattattgggcctgacataaaaggggagagcagggcggtattcaacaatgaagctgccgtgacagtggctaacagcaacgtcagacgctgccagtaaagtggaaaacggtgccagaagttttgcgcaaggagggcaggaaacaggctaataaccggcgttgccagcatgagataaccgttcaatagctgttcactatggagccagaacatcatcagcaaaggggggagcaccaacgcaggccagtagcggcgagagagcaaaataacaagggcgagataaactccctgcgggagaaacaacaccgcctgttgaccgttattggtcagataaaagctgagcgtccacagcatcagccagccggttccccaggctagcacaataaacagcaaaatcacccaatgacgaagattgcgcgacattaatgccccgccagcagatggtggtcgagcgcaaaatgtaccagttcaatggtgctatggcagttcagttttcccagcacattggcgcgatgcacatgtaccgttttatgactgagttcgagtttaaaggcgatctctttaacgctgtctcctttgaccagtaactcaaacacttcacgttctcgtggggtgagaatttccagcgcctgggcgggttgcccgccgccgcgtaaagcccgaatcgcatcggcacagagataatgcccgcccagcccgaccgagcgcaccgcctgtactaactcttccggcccacagcgtttggttaaatacccgctggcaccggcatccagcgcgctttgcacaaaggttggcgcgtcataaatgctaagaataatggcgcgaaattgcggtttttgtgcacgcaggcgcttaagcaaactgaggccgttttcgtccggcatggcaatatcaatgacggcaacattgacgtcatcacggattaatgccgaccatgcctgcgcggcactactgtactgaccaatgacctccagatcgtcttccagagagagtaattgtgcgaagccagagcgcaccacaacatggtcatccaccagcactacccgaatcatacttttcttctcttattatctaattctcctatcatgcatcacggcgcggcgctggcaatcaaccagcgacagatatggaatggatgtaacaaaatggcaataatttgccggagcgcgcacatcttatctggcttgtgaaccggcgggatacgttcgccaaaaccgcaaaatgcgcaaactcgctaaccattgccgatttttttctaaaaacgctttgttcttaacaagaccttttaattcctttatcaaactgacccgcaacga

SEQ ID NO: 30 - DNA  (genomic), 1394 bp; double-stranded, linear
tttctggtcaaacttacaatactttccatcactacaacgacgccacctatgctgatgacgtttactatgatggttatgtaggctggaacaactatgccgctgatagctattacaacggcgatatctacccggtcattaataacgctaccgttaacggcgtgatttctacctactatctggacgacggtatttctaccaataccaacgccaatagtctgacaatcaaaaacagcactattcacggtatgattacctctgagtgcatgactactgattgtgctgatgaccgtgctactggttatgtttatgatcgtctgacactgagcgttgataattcaacgatcgatgacaactacgagcattatacttacaacggtacctataataatgccgctgacactcatgttgtagatgtttacgatatgggtactgctattacactggatcaggaagttgatctgtccatcactaataactctcatgtagcaggtattacgctgactcagggttatgagtgggaagatattgacgacaacacagtcagcactggcgtaaacagcagcgaagtgtttaataacactattactgttaaagattctactgtgacctctggttcatggactgatgaaggtactactggttggtttggccatactggtaatgccagcaactatagcaacacgctgactgcagacgatgttgcaattgccgcaatcgcaaatccgtatgctgataatgcgatgcagactacagtaactttagacaactcaacactgatgggtgatgttgttttctccagtaatttcgatgaaaacttcttcccgcaaggtgctaacagctatcgcgatgctgatggtgatgtagataccaacggttgggatggcacagaccgtatggatgtgactctgaacaacggcagcaagtgggttggcgctgcaatgtctgttcatatggttgatgaagatggtgatggttcttacgacggatatgctgttggtactgaagcaactgcaactctgctcgatattgcagctaacagcctgtggccttcatcaactgtcggtgttgataacatcaatactcaatatgacgaaaatggccatatcgtaggaaacgaagtttaccagagcggtttgtttaatgtgactttgaacggtggttcagagtgggatacaacaaaatcttctctgattgatactttaagtattaacagcggttcccaagttaatgttgcagactctcgtctgatctctgacactgtctctctgactggcggttctaacctgaacatcggtgaagacggtcatgtagcgactaataccctgaccatcgacaatagtaccgttaaaatgtctgatgatgtttctgcgggctggggtttagaagatgctgca

SEQ ID NO: 31 - DNA  (genomic), 45 bp; double-stranded, linear
actgcttctatcgaagctggtcagaacgaagttgataacaacggt

SEQ ID NO: 32 - DNA  (genomic), 1939 bp; double-stranded, linear
tatgaatagaattaatatattggtcatctgtatggtcttattttttatgactggcaatgcatgtgccacagagtggatcagtagcgaggaccttatcacctctgactttcatcttatgacggcagatgagcgcaacgtggttaaagcggcaaccgacgatagtatggaagctgcttatatgctaaaagataatatccgctggtattatcataatggtgacctatcattacccgctaacttcagcaataaaaataaactggtggtgaacggtaatttaacgatttccggcgattatgatgattatctgtcaggtaatggtcatctgattgtattaggtaatgttattgtcgataactttattaatcatgatttcgcgtatgtcaaaggacagatgacagcgaaaggtttagtttatgctgattacaatgatcataactttgaagtgatgaagggaattagtgcgcgaggcattattgtttccgataaagcaacgcaatttgaagtcattaaagctgaattttatatcaatgaagatggaagtggtgaaggatataactgggatgagaatattcaaaaagcctattcactggtgactgccgatctttatgatcacactgaaatcgaaaccgataacatttccaatgcgtatcctgactatgatagcgtcgcagacaacatcgttcagggtttaccgctttttcgagataaagccgctcctgaaattaatgagaaattaaaatggattgaaacggggaaactcgataatttcccagcgaataaaataaagcatcaagatccactggtggcacgttttctgactcatacagagagtttatcacccgccgttatgctgcaactgttacagcaccccgatgaccagacgcgtgaatcgatggcgcagtcctggcccgctcaacagatgcattggcttaccgatgaattaattaaagatgaggctgttgccagagggctggttaaaaacagtaatatttccgccgatgtgaataaaaaattaatgtctgtacccgtcgagagcgtacagctggagcaggccagacaggataatctttctccagatattgttgcgtcgttaagtcatagcccctttctcagtgtacgcaagacattactcagccattacgattacgcctggctggttccgactgcagtggccgatgagttgataaataacgaagacccggagttacgtgaaagaattaccggagcagatttaaccgcacaacaagcagtgatgttgagtaaagataaatcactgaaagttcgtgaagcattagcccggacgcttactgaattaaaaattacccaactgtcagcaaccctgcgtacagaggatattgaacgtatcgcagaacaaatgtatctggataataaagaaaataaaaatatcgtaaaggtgttattgatagcgttgccggagatgcgtcaactgtctctggcaaaagaagatgtgcacaatttgcgcgaaggtgcgcgttatctgacatcgaaggacgtgattagttatctattgactcagcatgatgttcccaccgtctgggatgagctggcacgcgataaattattgccgctggaatataagaaacagttatggcaacgcacattaaatttaatgatgagcaaacggcaagaagatcaagagcaagcctacgaagtacagctggcgctgattgataatggtgttgttgacgaagagatgttaaataatgccattgatttactggttgatttacccgctgaataccgctatcgaatgcgtaaccaattatttgataataaagaattaccttccggaattatcaacaaactcgatcaacagtatcgcttcaactctgactgggcgctggctgttgtcagtatgaaaaatagcacccgtagacaaagtgaaagaggattacaccgctggaaccatgaggatagc

SEQ ID NO: 33 - DNA  (genomic), 372 bp; double-stranded, linear
gcgggagatctatgacttactgacgccaacgatcaacctgcaaattcactgtacccgttatcccatgcgcagccaaaatggtggaagcaccgatttaccgcgttattggatcacgttggataaaaacgtgatctgggattacccgaaagactttattgcaggcaacggtggagtgcgtaattttcacggtgaaacttgctggtatccttacctgacggatatttgttcaatttctgatttattgcgtgaatatattgacaccccaaaagcggagttgttaacaaaacaatttaccagcgataaatgggggttagtgaatattctgcgtgctgctgacaggcgaatagggatgaggcgattagatcagttacg

SEQ ID NO: 34 - DNA  (genomic), 1650 bp; double-stranded, linear
agcatctgttttatttgttacgtcgttagtcaccagccctgacactacgcagcgcaaaaaagctgctcaatgtcagggctgaatttgttaaatatttgtcccgatcgatatgagcgatttttggtattgtttgcccatgatgttatgtacaacatgctccaggataaccctgtagtggagcaaagatatgacaatttcaaattcgaatttattgaaaccgtttattactggtactgagttgccaccttttaaagaggatgtcttttctaaaacagaagaacaatttaaaaaaagcacctatggcaaatcgcttttcatttccggaaatgaaaacttagtaaacatttcagcggaaaaaatcgatgaaataaaaaatagcaaaaatttcttttcaaacattgtaaatataataattttactcattaagcatcctgataaaattctgcccattcttcatggttgtcctgtagagtcgatcgaagtcattaagaatgcgaaacgaacgggacaatggtcatatgagatgactgataagaacgggcagagtattgaagtgtcctatattttcactgataccatagatgataaatctgatggaaaattatgcttaaaaatctgtaactcctgcaaccaaaatgattctagtacacatgaatataaaatagatcatcaacagttgaaaaatcacataaggcaacttgaggagtgggcccttcttgaaaagttttatgataacaacgcttattattctaaacgtacaaaacaattagagaagaaaattgccgatgcggggtttataacaaggaaggttaaagccgagaactttaatgtaaaagagtttaaagacgatatagcctcgatgctttgtgaacagccccccatgcgtacacaccagatttcttcatccggatacgtatctgccgataaactgcacaaactctataagacaaatttggaagacgcgcagagagatctgaaaacaacaccggttgacatcgatggtgttagtctaaaatcaataactcgggaaaaaattgcggaagaaattgcgaaaaaaactgcggaaataattgcgaaacaaaatgcgaagagcattgaggagaagaatattgaaaaaaacaagaaacaaacaaattctgaggataattttgtcttaaaattctcaccggaagaaatcaatgagatgctcctggattacagcgatgaagaacaaaaaaaattaagaccttttttcactagtgatcacatctattgtttgtttgatgcttttagtcagggtttgcataatgttgctcgtaatggcagtccacggtatgcaggtttactacgtcaaatagcatccaagtctgcgatattacaagattttgatcaacaattgttctggcgcacgtttacaggaggggtcctccatcgacatatctctgtgaagagcgagccagaaaagacagatgtatggcgattcagtagccaatttgattttccacatataaatgaaaacggagagttgtccagaacggtactcatgttcgagggggttgctgaaagcaactttaaagatatcgccaatcattccagcgaatgtttttcttaccgttgttatgccgccccgctggatgcgaatgctaaaaaatagtgacgccggagtttgaa

SEQ ID NO: 35 - DNA  (genomic), 687 bp; double-stranded, linear
ggtgttttaaatccgttctgttaaaaaaaccgtggcgtatttgcgctgcggttttttttgcctgtttcacaggcaactgaatacggtttggttgtagaaagcgttctgacatatactttgtattaatagttaatacgtggagatcgcttatgcgcaaaattacctcagtaagcgttggcgaacaattagatagttttattacccggatggtccagtctggtcgttatggctcggccagtgaagtaatgcgttcggcacttcgtctattggaacaacaagaatccagggatgaagctgtcagaaatgctgttattgaaggtcttgagagcggtgaaagttcgatgacgcttcgtgatatcgcagcagaaaggaagcaaaaacatcgtgtataagcttagcggaaaagctgttgaagatttcagagggatctatgactacacgctgggaaagtttggtgatgagcaggcggatcgctataccgactctctcggcacttttctggatacactctctcaaatgcccgagatagggcaagactatgatgcgattccagaggtaaagaagatcgcatttaggtttcacactgtttattacgttataagagtcgatgacattctcattgcgcgcattcttcatcagttgatggaacctcgccgtcactggtaatgtgagaatttcttgactcag

SEQ ID NO: 36 - DNA  (genomic), 1983 bp; double-stranded, linear
ttaaatgccattgaccgggaggtgtaggcgattccagaccacccggtttgatttataaatgaacagtgccccaattttggggcactctgttaaagtaaaacccgacatcgccgaatatactatgcggcgatatttcaaggtgtatctttgtcactcataattcaatgacactgaaatatcgtcagtcgacgaactcataataattgctcatattctctgactgttgacgaaaaatatcatcaaaattattctcaatggtttcggtcatagtgttgaataaatttttagaaagttcatctattttgtcttgaatctttgattttatttcatcttgaatttcacgggtaaccaaaagttggtccaattgatcatccattttgtattttgcaattaattgtgcagttaaaggtactttcttcaaataatcattttttgttagtttatactggtctttgaaatattgtttggcttctgcttgtatatatttaaaaaattcattatactttttcctgcttattttttcttgaagattcattgcgcgattgaatattttctttaaatgctgattgtagaaaataaaattatcgatatcttgttttattttaataactgttgatttttcttcaaagtttaatgactcagggtttttatctgattcaatatagtcaagaataatttttgctaatgggctaatgtctttttcttctgttgattctgcttctgtttttaatatcggattaaaaaggtcggtacggtaaagtttcgtgcctttcatcctgacgatgtcaggaagaatagtgtttgaaagattagcctcgctaaagtccacattttggcaatcactttctgataaatctgcccaattgaaagtggttttcacacaggagcagttagttagaatcatccctttcgtttcattcccatctgatttctgataagttatcctttgtattatttgatctgcttctggatattgcatctcaggttctttttctttaccatatatcatcgcattatcaagaattgcgccagtgcaattcatatttgtcaggtcgcatttcttaaatctacaattgttaaaattcgcatttgtacaattcgcatttgtaaacttgacgccataaaaataagtatgttcgaagttgacatttgagcagttacagtttcccatatctataccgaaatctatatcgggatctttattgggatctttaccggaaatattgctgtgtgctagatatagaccgctgaaatcgtaatatccattgtcatccttttctattgggagtgaataagtctttactacctcgttaacaatagagatagttccacgtatcatcagattttctccgtctttataaaaaataatgttatgtttgatggtactgttgtatggctctggcaatgaggatgcaattttattccagaaacaacaaagcgtggtctgtttttgtttgggcgagaggcgatcaaaatccagctttaaatatgagtctaaatctgacgttgcatctatattaaagttgggatctggagttaacgctgaattataatttagaactgacaatgtattgatgtatttatgaatcgatttaaatgccttttgtttatcactgtccagaaaaaaatcacgaattttgttccacagcctttcaataagattttgatttaaatcttgcttcattgagtttcttaaatctgcaaccggtacatcagtaaacaggatcggttgtttggtgatggttttcatcatgattgtaatcctcttacgttgactaaataagacagttttaggggatattacctggagaaactatcaaaaatcgctcaaagggatgaagacgatgaatagctgcaaactcattcacgaagaatttctcttgcagaggtggattatggttacagaaggtgatgggaggtacgttgtccccatcatcgcagacgatggggaattcagcagataaaatgggtgaaaagcgaaat

SEQ ID NO: 37 - DNA  (genomic), 39 bp; double-stranded, linear
gtgatgccgccctttattttttactcgctttgtgaagcc

SEQ ID NO: 38 - DNA  (genomic), 53 bp; double-stranded, linear
caagccgcagcagatctgctttcgggcaggtctgctcatccacctcaggcaat

SEQ ID NO: 39 - DNA  (genomic), 25165 bp; double-stranded, linear
ctgcgcctttgtctttaattcaaattacctttcttattcctttaataaataagtcacaaaaaaatgatatatacgcgataaatctgtgatgctaatcacttattaccgtggattatttttaatgtgtatgatggtaatctaaaagtcgtagtgtattctaaataaataacgtataagctttttagctgcatttctttgcccatatcaatgatcgacaaaagagatgcacaagttattacccttcttaataaaacgagactggttataaaaaccagttaaaataatgacctggaaggaagtgacttatctatggcgcgattccagtttaaaaaccgtaaaaataatggacttattttttttataagttttatggtgatgggagaagctgcaattgctgcaccgctgccacaatgggcgaatgccccagcggtaacgccagttgcccaattatctttacaggaaagtatattacgcgcctttgcgcgaaatcccggtgtcactcaacaggcggcgcagataggtattggcgaagcgcaaattgatgaagccaaaagtgcctggtatccgcacgttggattaaccggcaacgcggggccgtcccgacaaacggactccagcggcaggcttgataacaacgtttcgtatggcataaccctgacacaactggtgtatgactttggtaaaactaacaacgatatcaatctgcaaactgccgcccgtgacagctaccgctttaaattgatggcaaccttaaccgatgttgcagagaaaacggcgactgcctacatggaagtcagtcgttatcaggctttgtgcgatgcggctcaacgcaatattcactcgctggaaaacgtctacaacatggcggcattgcgcgctaacgcaggcctgaactcatcgtcggatgaattacaggcccagacgcgtattgccggaatgcgctcaacgctggagcaatatcaggcgcagatggcgagcgccaaagcgcaactggcggtgctcactggcgtacagccggaggcgatagccgcgccacctgctgaattagccgagcagccggtatcgctgaagaatattgattaccagtccatcccgctggtgctggcggcagaaaacttacgccagtcagcacagtacggcgtggaaaaaacgaaagcgcaatactggccaacgctcagtattcaggggggtaaaacgcgctaccagaccagcgaccgctcgtattgggatgatcagctacaactgaacgttaacgcgccgctgtatcagggcggcgcggtttctgcccaggtgcaacaggccgaagggcaacaaaaaatctctgcctcgcaggtcgaacaggcaaaactggatgtgctgcaacgagcgtctgtggcatatgcgaactggaccggcgcacggggtcgtgaagaagccggtttagcgcaatccgaaagtgcgcacaaaacgcgagatgtgtaccaaaatgaatataaattgggtaaacgcagtctgaatgatctattaaccgtcgaacaagatgtctttcaggcgcaatcggctgaaataaatgccaattatgatggctgggtcgccgccgtaaattatgccgctgcggtgaataaccttattccattagcgggaattaaacagggcttatacaacgacttacccgacttgaaataatcctgccattattaatagtgggccgttgttaagtgattacctttgtcttatttagataaatggactcgctaaggatgtgcgccatttatcaggaatgccattatgagcctgattattgatgttatttcgcgtaaaacatccgtcaaacaaacgctgattaatcctggcgacgtcacggttgttatttatgagccttccgtggtgcaggttcatgctcaggcctctgccgttgcgcgttacgtccgtgaaggaaatgacctgctgatctatatgcaggacggcacggtgatccgctgcaacggttatttcctgcaagcggcgaatacagctgaacaatcggaactggtgtttgccgatggtcaacagctaacccatatcacctttgccgatactgctgcgggtggattagcccccgtagaactgactgcccagaccactgcgattgaaagcattgcgccatttcttgataccgttgctcagaccagcgccttcccgtggggttggctggcgggggcggcggtaggtggtggcgcgcttggtgcactgctggcaagcggtggcgatggcgactcgaaaacagaagtgattaataaccctacgccacctgctgagcctggcaacgccacaccatcatttttagttaccgataatcagggcgatcagcgcggcattctagccaccaatgacatcaccgatgacaccacgccaacctttagcggcagcgggcaggcgggggcgactattcagattaaagacagtaacggcaatactattgccagtactcaggtagacaacaacggtcactggagtgtctcgttacccacgcaaagtgcaggtgaacatacctggtcagtggtgcaaattgtcggcagtaccatcactgacgccggttcgataacgttaaccatcgacaatagtcaggccagcgtgcaggttgccaccaccgcaggcgataacattattaacgccagcgaacaggccgccgggtttacgctttctggcaccagtagccatctggcgcagggaacagaactcaccgttacgctaaacggcaaaacctacacgaccagcgtaggcgctaacggtgcctggagcgtgcaggtgccgaccgccgatgcacaggcgttaggcgaagggaatcaggcggtgctggtcagtgggaaagacgccacaggcaatacggtcaccggcgcgcagctactaacggtcgatacccaaccgccaacgcttgccatcaacaccatcgctcaggacaacattatcagtgctgcggaacataacgtcgcgctggtactgagcggcacgtcgaatgcagaagcggggcaaaccgtaacactgaccgtcaacgggaaaagccatacagcaaccgtcggtagcgacggaacctggcaagtgacgctgcctgccacggaagtccaggcactggcggagggtaattacgctgtcaatgccagtgtcagcgatcgggcagggaacaccaccagccacagcgcgaatttcacggtagacacctcagcacccgtggtcagtgttaataccgtggcgggcgacgatattcttaataatgccgagcaggccgtcgcgcagatcatctccggacaagtcagcggtgcttctccaggcgatacggtaacggtgaaattgggcactcatgtcctgacgggcatcgtgctggcagatggcagctggaatgtggcgctggacccagcggtaacccgcacgctggatcgcggagccaatacgattttcgtcaccgtgacagatgctgcaggaaatactggcgcggcgtctcgagcaatcacgctggtcggtgtttctccgttgatcaccattaacaccgtctccggcgatgacattatcagtggcgcagaaaaaggtgcgccactgacccttaccggtagcactcaacaggctgagacaggacaaaccgtcacagtaaccctggctggacagagttttaccactaccgtgcaggccgatggctcctggagtctgacggtacctgccgccgcgatgggaaatctgcctgacggcgcggtggcgattaccgcttctgtgacggatctcagcggcaataccggcaacacttcccgcaccattaccgtcgatagccaggccccggccttaagcattgatccactgaccgctgataacatcattaacgccgccgaaagcgggcaggatctgcccatcaccggcaccaccgacgctcagccggggcagacggtgaccgttacgttaaatgggcagacgtatcagggcgtcgtgcagccagacggcacctggagcgtgactgtgcccgccgccaacgtgggcgcactggctgacggcaacgctacggtcaccgccagcgtgaacgatgtcgccggtaatccgagcagcgtttcacgcgtggcgctggtggatgccacgccgccggtggtaaccattaatccggtggcgaccgataacgtcatcaacacgccggaacatgctcaggcgcaaatcatcagcggcacggttactggcgctcaggcgggcgatatcgtcaccgtgacgctgaataatgtggattacaccacggtggtggatggttccggcaactggagtctgggcgttccggcctcggtggtcagtgggctggcggacggcagttatcctgtcagcgtctcggtaaccgacaaagccggaaacacgggcagccagtcattgaccgtcacggtcaataccgccgcgccccttatcggcattaacagcattgcgggcgatgatgtgattaacgccagcgaaaaaggggccgatctccagattaccggcaccagcgatcagcctgttaacaccgccatcaccgtgacgctgaacgggcaaaattacaccaccacgaccgacgcctccggcaactggagcgtcaccgttccggcatcggcggttacagcattaggccaggccaactatacggtaacggcggcggtgaccagcgatatcggcaacagcgccactgccagccataacgtgctggtcgacagcgcgctgcccggtgtgaccattaatccggtggcaaccgacgatattattaacgccgccgaagcgggcgtggcgcaaaccatcagcgggcaggtgactggcgcggaagatggcgacacggtaactattacgttgggtggtaatacttatacggcgacggtgggcagcaatctcacctggagcgtggacgttccagcggcagatattcaggcgctgggaaatggcgatttaacggttaatgcctcagtcaccaatcaaaacggcaacaccggcagcggcacgcgggatatcaccatcgacgccaatctgcccggcctgcgggtcgatacggtggcgggcgatgatgtggtcaatatcatcgagcacgggcaggcgctggtggtcaccggcagcagctcggggctggctgaaagcacgccgcttaccgttacgattaataatgtggaatacaccactgcggtgcaggccgatggtagctggagcgtgggcgtcacggcggcgcaggttagcgcctggcctgcggggacggttaatattgccgtttcaggggaaagtagcgccggaaactcggtgagcattacgcatccggtgacggtggatctcactccggcagcgatcaccatcaacaccatcgccacggacgatgtgattaacgccgcagaaaaaggcgctgatttaaccctttccggcaccaccactaacgtagaacccggtcaaaccgtcaccgtcacctttggcgggaaaaattacactgccagcgtagcgagcgatggtagctggactgccaccgtacccgccgccgatctggcgtcattacccgagggcagcgcctccgcactggccagcgtcagcaatatcaacggcaatagcgcctcggcggtgcacaactacagcgtcgacagcagcgcgccaaccatcattatcaataccgtcgccagcgacaatatcgtcaacgccagcgaagccgatgcgggcgtgacggtgagcggcagtaccaccgccgaagcggggcagattgttacgataacgcttaacagcccgaccgtgcagacctatcaggcaacggtgcaggcggacggcagctggagcatcaatattccggcggcagatcttgaggcattgaccgatggcagccacaccctgaccgccacggtcaatgacaaagcgggcaatccggcgagcaccacgcataatctggcggtggatctcaccgttccggtgctgaccatcaacaccattgcgggcgatgacattattaacgccaccgaacacgggcaggcgctggtgatttccggttccagcaccggcggagaagcgggggatgtcgtcaccgtcacgctaaacagtaaaacctacaccaccaccctggacgcctccggcaactggagcgtcggcgttccggcggcggatgtcacggcgcttggcagcggcccgcaaactgtcaccgccacggttaccgatgcggcaggcaacagcgacaattagacacacacggtcaccgttaacctcaccgcaccaaccattgacatcaacaccatcgccaccgatgacataattaacgccagcgaaaaaggcgcggatctgcaaatttccggcaccagtaatcagccagcaggcaccacgattacgctggcgcttaacgggcaaaattacaccgcgacgacggacgctgcaggcaactggagcactacggtgccagcttccgcagtaggtgcgctgggcgaagccagctacacggtgacggcgaacgtcaccgacagcgcaggcaacagcaattccgccagccataacgtgcaggtcaataccgcgctgcctggcgtcaccattaacccagttgcgaccgacgatattattaacgccgccgaatcgggcaatgcgcaaaccatcagcggccaggtgacgggggcggcggcgggcgatacggttaccgtaacgcttggcgggaaaacttacaccgctaccgtgcaggggaatttaagctggagcgtggacgttccggcggcggatattcaggccatcggcaatggcaatctgacggttaacgcttcggtgaccaacggcgttggcaatactggcagcggttcgcgagatattactatcgacgccaacctgccaggtctgcgcgttgacaccgtggcgggcgatgatgtggtcaatagcatcgagcacgctcaggcgctggtgataactggtagcagcagcgggctggcggcgggcgcggcgctgacggtggtgattaacacggtcacttacgctgcaacagtattagccgatggcacatggagcgttggtgttccggcggcagacgtgagtaactggcctgcgggtacggtgaatatcacggtaagtggcactaacacagccggaacaacatccaccatcacccatccggtcaccgtcgatctggcggcggtggcgatttccattaacaccgtttccggcgacgatgtgattaacgccgccgaaaaaggggcagatttaaccctttccggcagcacctccggcgtggaagtggggcaaacggtcaccgttacctttggcgggaaaacctacaccgctaccgtagcgggcgatggtagctggacaaccaccgtacccgccgccgatctcagcgtgttacgcgacggcgacgccaccgtgcaggccagcgtcagcactattaacggcaacacggcttcggcaacccacgcctacagcgtcgatgccacggccccgacgcttgccattaacaccatcgccaccgacgatattctgaacgctgccgaggcgggcaatccgttaaccatcagcggtagcagcaccgccgaagcggggcagacggtaaccgtcacgcttaatggtgtgacttacagcggctccgtccaggcggacggcagctggagcgtcagcttaccgacggcggatctcagcaatctgaccgccagccagtacaccgttagtgcctcggtaagcgataaagcgggtaacccggcgtccgctaaccacgggctggcggtggatctcaccgtgccggtgctgaccatcaacaccgtctccggcgatgacattattaacgccgccgaacacggacaggcgctggtgatctccggctccagcactggcggcgaagcgggtgatgtcatcaccgtcacactaaacagtaaaacctacaccaccatgctggacgcttccggcaactggagcgtcggcgttccggcggctgacgtcactgcgcttggcagcggcccgcaaactatcactgcggcaattaccgacgcggcaggcaacagcgatgacgccagccgcacggtcaccgtgaatctcgccgcgccaaccattggtatcaacaccatcgccaccgatgacgtgattaaagccacggaaaaaggcgcggacctgcaaatcaccggcaccagtaatcagcctgcgggcaccaccattacggtgacgctgaacgggcaaaattacaccgctactaccgatagcaacggcaactggagcgccacggtgccagcgtcagcggttagcgcattgggtgaagccaactacacggtaacggcaaacgtcactgatacggcaggcaacagtaattccgccagtcataatgtgctggtcaacagcgccttgcctgccgttaccattaacgcggtggcgactgacgatattattaacgctgccgaatcgggaaatgcgcaaaccatcagcgggcaggtgacgggcgcagcgcagggggatacggttaccgttacgctgggcggcaacacctacaccgccacggtgcagtctaatttaagctggagtgtggacgttccggcggcggatattcaggcgctgggcaacggcgacctgacggttaatgcctcggtcaccaatggcgtcggcaacaccggcagcggctcgcgcgatatcacgatcgacgccaatctgcctggcctgcgggtcgataccgtggcgggcgatgatgttattaacagcattgagcacaatcaggcgctggtgatcaccggcagcagcagcggattaacggcgggaacggcgttaacggtcgagattaacaacgttacttatggcgcgacggtattagccgacggcacgtggagcctcggtgttccggcggtagacgtcagcaactggccagcgggtacggtgaatatcacggtaagcggcaccaacagtgccggaacaacctccaccattacccatccggttaccgtcgatctggctggggtcgccatcaccattaacactctctctggtgatgatgtgatcaacgccgtcgaaaaaggcgaaacgctggtcgtaagcggcagcaccagcggtgtcgaagccgggcagacggtgaccgtcacctttggcggcaaaaattacaccaccacagtggaagctaacggtagctggacggtgaatgtgccgcctgccgatctcgctgcgctaccggacggcgcgggcaacgtgcaggcgagtgtcagtaatattaacggcaacagcgcccaggccgatcgcgcgtatagcgttgatgccaccgcgccgcttgtgaccatcaacaccatcgccagcgacgatatccttaacgtgagcgaagctggcgcggggatcaccatcagcggcactaccacggcgcaggccgggcagacgctcaccgtcacgctcaataacaacacgtaccagaccaccgttctggcggatggcacctggagcgtgaatgttccggcagcggatttaagcggattaaccgccagcagttacaccgtgaccgccacggtgagcgacaaagcgggtaacccggcaagcgccgaccacgcgctggtggtagatatcactgcgccggatctcaccattaacaccgtcgcgggcgatgacattatcaacgccatcgaacatggtcaggcgttggtggtcagcggcaccagtacgggcgcggcggcgggtgatgtggtaaccgtcacgctgaacggtaaaaactacaccaccacgctggatgcctccggtaactggagcgtgggcattccggcggcggatgtcacggcgctggcgaccggtagccagaccatcaccgccagcctgagcgatcgcgcgggcaacagcgacagcacgactcacgatgtgaccgttgatcttagcggcccgacgctgaccattaacaccgtctccggcgatgacattatcaacgccgctgaaatcgttgtggcgcagaccatcagcggtcaggtcacgggaacggcggttgccgggaatacggtgattgtcaccattggcggcaatcaatataacgccaccgtgcagtcagatttaagctggagcgtcagcgtaccggcgaacgttttgcaggcgctgggtaacggtgaactgaccatcagcgcctcgttgaccaattccgcaaataataccggcaccgcgacgcacgatatcgtgatagatgccaacctgccaggtctgcgcgtcgataccgtggcaggcgatgatgtgattaacagcatcgagcacactcaggcgttggtgatcaccggtagcagtagcggactggcggcgggcgcggcgttgacggtggttatcaatagcgtcacctacggcgcaacggttttagcggatggtagctggagcgttggtgttccggtggcagatgtcacaaactggcctgcggggacggtcaatattgccgtctctggcaccaacaccgccggaaccacaaccagcattagccatccggtcacggtcgatctcgctgccgtggcgatcaccatcaacaccctttccactgacgatgtgattaacgccgccgagaaaggctctgatttgcagctctccggcaccacctccggcgtggaagcggggcaaaccatcaccgttatcttcggcggcaaaagctacaccaccacggttgccgcggataatacctgggggctgacgatccctgccgtcgatgttgcaaccttgccagacggcgcagcaaacgtccaggccagcgtcagcaatgtcgcagggaacagcacccaggcaacgcatgcttacagcgttgatgccactgcgccctccgttaccatcaacaccatcgccacggacgatattcttaacgccgccgaagcgggatcggcgctgaccatcagcggcaccagcacggcggaagccgggcagacggtgaccgtaacgctaaacggcgttaattacagcggcaatgtgcaggcagacgggagctggagcgtcagcgtaccaaccggcgatttagctagccttaccgccagctcgtataccgttaacgcctcggtcagcgacaaagccagaaattcggcttcggcaacgcataatctgacggtggaccttgccgctccggtcgtcaccatcaacacggtggcgggcgatgacatcattaacgccacggaacacggacaggcgcagatcatcagcggctcggcaacgggcgcgactaccggtaatacggtttccgtgacgattggcacgaccacctataccaccgtgctggacgccaacggcaactggagcatcggcgtgcctgccagcgtgatttccgcgctggcgcagggcgatgtgaccattaccgctacggtcaccgactccgcaggcaacagcggcacggcctcgcacactgtcaccgtggcgctcggcgctccggtgctcgccattaacaccattgccgtcgatgacatcatcaacgccgcggagaaaggcgcggatctggcgattaccggcaccagcaaccagcctgcgggcacgcagattaccgttacgctcaacgggcaaaattacaccaccactgccgatgcttccggtaactggagcgtgaccgttccggcgtcacgggtgagcgccctcggtgaagccacctacacggtgaccgcagccgccactgacgccgatggcaacagcggttccgccagccataacgtacaggttaataccgcgctgccgggcgtcaccattaacgtggtggcaacggacgatattattaacgccgccgaagcgggcgtggaacagaccatcagcgggcaggtgacgggtgcggcggcaggcgacacggtgaccgtcacgctcggcggggcgacttacactgccacggtgcaggcgaatttaagctggagcgtcgatgttccggcctccgcgctacaggagttgggcaacggcgaactgaccatttcggcttcggtgacgaacagcgtaggcaatactggtaacggcacgcgcgaaatcaccatagacgcgaatctccccggtctgcgggtcgacaccgtggcgggcgatgatgtggttaatattatcgagcacgggcaggcgctggtgattaccggcagcagctccggtctggcggcgggcagcaacgtcacgctgaccattaacgggcaaacctatgttgcggcggtgctggcggatggcacctggagcgtcggcgttccggcggtggatgtcagcgcctggcctgcgggatcggtgacgattgcggcgagcggtagcacctctgccggaaatccggtaagcgttacgcatccggtgacggtcgatctctcggcggtggcggtgagcatcaacgccattaccgccgatgatgtgatcaacgctgccgaaaaaggcgcggcgttaacgctctccggcagcacctctggcgttgaagccggacaaacggttaccgtcacctttggcggcaaaacttacagcgccacggtggctgcgaatggttcctggagcacctcggttccggcggcagatatggcggctctgcgtgatggcgatgccagcgcacaggccagcgtcagcaatgttaacggcaacagcgccaccacgacccacgcttacagcgttgatgccagcgcgccaacggtgaccattaataccattgcgggcgatgatattcttaacgccgccgaagccggagcggctctgaccatcaccggcagcagcacggcggaagcggggcagacggtgaccgtcacgctcaatggcacaaactacaccggcaccgtacagacggacggcagctggagcgtcagcgtaccgtcagccgacttaagcaccctgaccgccagcaactacaccgtgaacgcggcggtgagcgacaaagccggaaacccggcctcggttaatcacaacctgacggtggatacgtccgttccggtcgtcaccatcaacacggtggcaggcgatgatgtgatcaacgcgacggaacacgcccaggcgcagatcatcagcggctccgccactggagcggcaaccggtagcaccgtgacggtgactatcggcacaaatacctttaccacggtgctggatgccagcggcaactggagcgtcggcgttccggcaagcgtcgtctcggcactggcgaatggcacggtgaccatcaatgccagcgtcaccgatgccggaggaaacagcggcagcgctacccatcaggtgacggtcaataccgggctgccgaccattacctttaacgccatcagcggcgataacatcctgaacgccgatgaaaaaggccagccgttgaccatcagcggcggcagtacggggctggcgacgggcgcgcaggtcaccgtcacgctcaacggtcacaactacagcgccaccaccgacgcatcgggcaactggaccttaaccgtgccggtgagcgatctggcggcattaggtcaggccaactatacggtcagcgccagcgccaccagtgcagcaggcaacaccgccagcagccaggcgaatttactggtcgacagcggcctgccggacgtcaccatcaacaccgtggcaggcgacgatattatcaacgccgccgaagcgggggccgatcaaaccatcagcggggtggtgactcgcgccgccgctggcgatacggtcaccgtgacgctgggcgggaacacttacaccgctacggtacagagcaacttaagctggagcgtcagcgttccgacagccgatctccaggcgttgggcaatggtgatttgaccattaccgcctcggtcaccaacgctaatggcaacaccgggagcggcacgcgggatatcaccattgatgccaacctgccggggctgcgcgtagataccgtggcgggcgatgatatcgtcaacagcatcgagcacgggcaggcgctggtgatcaccggcggcagtagcggcctgaatgcaggtgctgtgctgacggttaccatcaacagtgtggcgtattccgccacggtgcaggcggacggaagctggagcgttggcattccggcggcaaacgtcagcgcctggcctgcggggccgttaaccgtggaggtagacgggcaaagcagcgccaataacccagtcagcgtcagccatccgttcaccgtcgatttaacggcggtggcaatcagcatcaacaccgttgccagcgacgacgtgattaacgccgcagaaaaaggcaccaatctgactctttccggcagtaccagcgggattgagagcgggcaaaccgtcaccgtcacttttggcggtaaaacctacactgcaagcgtcgccgccaacgggagctggagtgtaaacgttccggcggcagatctggcaactctgccagagggcgcggcgaatgtgcaggccagcgttagcagcgcgagcggtaacagtgcctcggcgacccatgcgtatagcgttgacgccagcgcgccgacgctcaccattaacaccatcgccagcgacgatatccttaacgccgcagaagccggaagcccgctcaccatcagcggcaccagcaccgccgaaaccgggcagacggtgaccgtcacccttaacggcgcaacctacaccggcactgtgcaggcggacggtagctggagcgtcagcgttcccacttcagccctgggcgcgctcaacgcaagcaattacaccgtcagcgccacggtcaatgacaaagcgggcaaccccggcagcgccagccataatctggcggtagacaccaccgcgccggttctcaccattaacaccgtggcgggcgatgacatcatcaacgatgccgaacatgcgcaggcgctggtgatctccggcaccagtagcggcggggaagcgggcgatgtggtgagcgttgtgctcaacggcaaaacctacaccaccaccctggatgcctccggcaactggagcgttggcgttccggcggcagatgttacggcgctgggtagcggtgcgcagaccatcaccgccagcgtcagcgatcgggcaggcaacagcgacgacgccagccgcaccgtgaccgtcagcctcagcgcgccagtgattagcatcaacaccatcgcgggcgatgatgtgatcaacgcgacggaaaaaggatctgatctggcgctttctggcaccagcgatcagcctgcgggtacggcgatcaccgtcaccctgaacggacaaaactacagcgccaccacggatgcctccggcaactggagtgttaccgtgcctgcctcggcggtcagtgcgctgggcgaagcgacctacagcgtgacggcgagcgtcaccaatgctcagggtaacagcagcaccgccagccataacgtgcaggttaataccgcgctgccgggcatcaccattaatccggtggcgacggacgatattatcaacgcttcagaggcaggcagcgcgcaaactatcagcggccaggtaaccggtgcggcggcgggcagcaccgtcaccgttgaactgggcggtaaaacttacaccgccaccgtccaggctgatttaagctggaatgtgagcgtacctgccgccgactggcaggctctgggtaacggtgagttaacggttaatgcctcggtgaccaacgccgttggcaacaccggtagcggcacgcgcgatatcaccatcgatgccagtctgcctggcctgcgggtggataccgtcgcgggtgatgatgtggtcaatatcatcgaacacgctcaggcgcaggtgatcaccggcagcagctccggctttgccgcaggcacggcgttgacggtggtgattaacaaccaaacttacgccgccacggtgttggcgaacggtagctggagcgtcggcgttcctgcgacggatgtcagtaactggcctgcgggaacgctgaatattaccgttagcggggcgaacagtgccggaacgcaaaccagcattacccatccgctgactgttgatctcaccgccgtcgccatcagcatgaacagcatcaccagcgatgatgcgattaacgccgccgaaaaaggcgcggcgttaacgctctccggcagcacgtccggcgtcgaagcggggcaaaccgtcaccgtcacctttggcggcaaaacctacaccaccacggtggcggcaaacggtagctggagcaccaccgttccggcggcggatttggcggccctgcgtgatggcgatgccagcgcccaggtgcgggtgactaacgtcaacggcaacagcgccacagcaacgcacgaatacagcgtcgatagcgccgcgccaacggtgaccatcaacaccattgccagcgataacatcatcaacgccagcgaagcggcggcgggcgtaacggtgtccggcaccagcaccgcgcaaaccgggcagacgctcaccgtcacgcttaacggcactaactaccagaccacggtgcagacagacggcagctggagtttaacgctgcccgccagcgacttaaccgcacttgctaataacggctacaccctgaccgccacggtcagcgatctggcgggtaaccttggcagcgccagcaaaggcgtgaccgtcgataccactgcgccggtgatcagttttaacaccgtggcgggcgatgatgtgattaacaacgtcgaacacattcaggcgcagattatcagcggcaccgccacgggcgcggtggcgggcgaccgcctggtggtgaccatcgccgggcagcagtatgtcaccagcaccgatgccagcggcaactggagcgtcggcgtgcctgccagcgtgatttccggccttgcggatggcacggtgaccatcagcgccaccattaccgatagcgcaggcaacagcagcacgcagacgcacaacgtacaggtgaacacggcggcagtgtcgctctcggtcagcactatcagcggcgataaccttattaacgccgccgaagcgggcagtgcgctgaccctgagcggcactggcactaatttcgcgacaggtacagtggtgaccgtgttgcttaacggcaaaggctacagcgccaccattcagagcaacgggagctggagcgtgaacgtgcctgcggcggatgttgcggcactcagtgatggcaccagctacacggttagcgcctccgctcaggacagtgccggaaacagcgccacggcctcgcgcagcgtggcggtggatctcaccgcgccggttatcagcattaacaccgtttcgacggacgaccgcttcaacgccgccgaacagcagcagccgttaacccttaacggctcgaccagcgcggaagtggggcagacggtcaccgtcacctttggcggcaaaacctataccgccacggttgccgccaatggtacctgggcgctgaacgtgcctgcggtggatctggccgcgctcgggcagggcgcgcagaccattaccgccagcgtgaacgatcgcgccggtaaccccggacaggccacgcacgccctgaccgtcgataccgttgcgccaacggtcaccatcgccacggtggcgggtgacgatattatcaacaacgccgagcagcttgccgggcagaccattagcggcaccaccaccgccgaagtgggccagacggtgaccgttacctttaacgggcaaacctggagcgcaacggttggcagcggcggaagctggtcggtgtttattccggcgcagcagtttgccggattaagcgacggcagctacaccattagcgcgacggttagcgatcaggccggaaaccccggcagcgccagccgtggcgtgacgctgaacggcgatgtacctactgtcaccatcaacacctttgcgggcgacgatgtggtgaatgcagcggaacacggctcatcgctggtgatcagcggcaccaccaccgcgcccgtcgggcagacgctgaccctgaccttaaacggcaaaacctacaccaccacggtgcagacgggcggtagctggagctacaccctcggcagcgccgatgtcaccgcgctggcggacggcaacgcctacgtgattaacgcctcggtgagcaatgccattggcaacaccggtagcagtaatcacaccattaccgtcgatctcagcgctccggcgatgggcattaatatcgattccctgcaagccgacactggccttagcgccagcgactttatcaccagcgtcagtccggtagtggtcaacggctcgctcaccgccgcgcttgccagtaacgagacggcgcaaataagtatcgacggcggcacaacctggaccacgcttaccgttaccggcacgacctggcgctataacgacagccgcacgctgaccgatggcaactatctctatcaggtgcgggtgattgacgcagcgggcaacgttggcgcgaccgacagccagaatgtggtgatcgacactaccgcgccagatcccgcggtgaaaaccatcgccatcagcgcgatcaccaccgatatgggcttgatcactaacgattttgtcaccagcgacacgacgcttgcggtgagcggcacgctgggggcgacgctttctgccggtgagttcgcgcaaatcagcctcgacggcggcgtcacctggactacgttaaccgtcgttggcaccagctggagctatgccgatggtcacacgcttactgacggcacctggaactacacggtgcgggtggtggatctggcggggaacgttgggcagaccgcaacgcaaaacgtggtggtcgacaccaccagcccggaagcggcgaaaagtatcaccattaccggtatcagcgatgacaccggaaccagcagcagcgattttattaccagcgacaccacgcttaccgtgcgcggcgtattgggcgcggcgctcggcgctaatgagttcgcgcaaatcagtaccgacaacggcgcaacctgggtgaacgtgaccgtcgccgcagacagcctgaactggagttacgttgacggacgaaccctcaccaacggcaccaccacctggcaggtgcgggtggtcgatctggcgggcaacgttggcgcaacgagcagccagtcggcgctgatcgataccgttaacccggcgcaggtgctcaccatcgccagcatcagcaccgacacggggagttcggcaactgactttatcaccagcgacaccatgctcacgctgaccggttcgctgggggcggggcttgccagcggcgaagtggcgcagattagccttgatagcggcgcgacctggacaacgctcaccaccaacggtacacagtggacttacaccgacagccgcacgctgaccgacggcagctacgtttatcaggtgcgggtgctggatctggcggggaacaccggcccggtggtgtcgaaaacggtggtggtcgatacgattaaccccaccgccacaccaacgattgtgtcgtataccgatgatgtcgggcagcggcaggggacattaagcagtttgcaggccaccgacgacactacgccgctgctgaacggtgtactttccgcgccgcttgccagcggtgaagtggtttacctctaccgtaacgggctgctgttaggggcggtgacgatggtcggcgctctgaactggacctacagcgacagcgggctggtgagcggtgcctatacctacagcgcgcgagtggtggatttggcggggaatatcacctcctccagtgattttgtcctgacggtcgatacctctattccgaccacgctggcgcaaatcaccagccagaccacgcgcgatactacgccgattattagcggggtgatcaccgccgcgcttgccagtgggcagtatgttgaagtggtgatcaacggcaaaacctacacctctgaaccgggcggcgcggtagtggtcgatccggcgcacaacacctggtatgtacagttgccggataccgatgcgctgacagtttccgcgaccgcctataccgttactgcgcaggtaaaaagttcggcgggtaacggcaataacgccaatattagcaacggcacggtgacggttaacgcggcgattgattacacaccgacctggactaccgccagcaaaaccaccgcctgggggctgacctacggcctcgactcgcacgggatgtggacggtgctggcaaaccagcaggtaatgcaatcgactgacccactcacctggtcgaagaccgcgctgacgctgtatcagagcggcaacaactacgccaccagctccattgccgattacgaccgtaacggcacgggcgatctgtttatcacccgtgatgactacggtacgggctatattaacggctttaccaataacggcgatggcaccttttccagcgctattcaggtcaccgtcggcaccctgacgtggtacggctcgattgtggcatttgataaagagggcgacggctatctcgacttctggattggtgacgctggcgggccggactccaacaccttcctgtggaacaacgcaggcacgctggtaggcaactccaccacgtcgaacagcggcggtagcgccacggtgggcggggcggtgacggggtatctttcgctcaacgaaggttctggcgtcgatctgaacaatgacggcaggatcgacctggttcagcacacctataacctgaacaactattacacgctgtcttcgctcatcaaccaggggaatgggacgtttgtctgggggcagaacaccaccaataccttcctgagcggggcgggcagtggcgctatgagcagcagcgtttccatgacctgggccgatttcgatggtgacggcgatatggatctcttcctgcccgccagccagggaagagctaactacggctcgctgttattcaacaccaacggcgtactgggttgcccggtggcggtgggcgcaacggcaaccacctacgccagccagtttagcctggcggtggactggaaccacgacggcctgatggatatcgcccgtatcgcccagaccgggcagtcgtatctttatactaacgtcagcaacgccagcaactggacgcaatcggccctcggcggcagccagagcggtaccaccagcggcgtggcggcaatggactacgactgggacggcgcggtggatgtgctggtgtccaaacagtcgggcagcgtgttcctgagccgcaacaccaacacggtgagctacggcacttcgctacacctgcgcatcaccgatcccaacggcattaacgtctattacggcaataccgtgaagctgtacaactcggcgggagtgctggtcgccacgcaaatcatcaacccgcagtcgggtatgggggttaacgacacctcggcgctggtcaacttctacgggctgaatgccggagaaacctacaacgcggtgctgatcaaatccaccggcaccaccgccagcaatatcgaccagacggtcaacaccagctggggcggtttacaggccaccgatgccactcacgcttacgatctcagcgctgaagcgggtaccgcgagcaacaacggcaagttcgtcggcaccggctataacgacaccttcttcgccaccgcaggcaccgacacttacgacggttccggcggctgggtgtacagctccggcaccggaacgtggctggcgaacggcgggatggacgtggttgatttccggctttcgacggtgggcgtgacggctaacttaagcagcactgccgcgcaggccaccggttttaacacctcgacatttaccaatatcgaaggcatttccggctcgaattttaacgacattctgaccggcagcagcggcgataaccaactggaagggcgcggcggcaacgacacgctcaacatcggcaacggcggccacgacaccttgctctataaactgctcaacgccagcgacgccactggcggcaacggctcagacgtggtgaatggctttacggtagggacatgggaaggcaccgccgacaccgatcgcattgatattcgtgaactgttacagggcagcggctacaccggcaacggcaaagccagctacgtcaacggcgtggcaacgctggatgcgcaggccggaaacatcggtgactttgtcaaagtcacccagagcggcagcgacaccatcgtgcagatcgaccgcgacggcacgggcggcacttttgcgacaactaacgtggtcacgctgacgggcgtgcacaccgacctcgccaccttgctggcgaatcatcagttgatggtggtgtagataatgaaaaaaaatgcccagtccgtggaagcctggctggaggcgatgatcgccgtggcgcgctattatcggctcgatttttctcaggagaatgtgcgcgcgaccgtcaactgggagcgcgacagtaagcgggaggagttactcaccgacatggcgcggcagttagggatggggttgcggttggtggagttttccgccgattcgcttaacccctggcgtctgccgctgatcgcggtgtttgataatcagcagattggcgtgatcacccgtcgcgacaatcatgacaatatcagcgttcagttcagcggtgacgaagggctggaaactacacttaacgtcgcggatattgaagataaaatcgtcgaactggcgctgctgcgccctctcagcgccatccctgacgcgcgggtggatgactatattcgcccgtatcaggcgaactggttctggagtctttcgctaaaagactggcggcgctacggcgatattatgctggcgtcactggtggcgaacgtgctggcgctggcggcgatgattttctcgatgcaggtttacgatcgggtggttccggcgcaatcgtacccgacgctatgggtgcttttcgccggggtgatgatggcgatcctgtttgagttctgtatgcgcatggtgcgtacgcatctatctgatgtgatcggaaagcgggcagacctgcgtatttcggatcgcgtttttggtcatgcgctacggctgaaaaacaacgtgcgatcgaaatccaccggatcgtttatctcgcagatccgcgaactggaatcagtgcgggagcttattacgtccaccaccatcggcgcggtggcggacctgccattcttcctgctgtttgtctttattttgtggatgatcggcggctggctggtgctggtggttttgctggcgctgccgttgctggtgatccccggcctgctggtgcaacgcccgctggcgcggctggcgaacgaaggaatgcgcgagtcagcggtacgcaacgctacgctggtggaagccgtgcagtcgattgaagatattaaactgctgcgcgccgaacagcgttttcagaatcagtggaaccacaccaacgacgtggcctcgtccatcagcatgaagcaacgttttctcaccgggctgctgctcacctggacccaggaagtgcagtccatcgtctacgtggtggtgctgctggtgggctgctttatggtgatgaacggcgacatgaccaccggcgcgctggtcgggacgacgatcctggcttcgcgcaccattgcgccgctgtcgcagatatccggcgtgctctcgcgctggcagcaggcgaaagtagcacgtaacggccttgatgaactgatgaagcgcccggtggatcagccggaacacggcaaactggtgcataaagcggtgctgcacggtaattatcagttcagcaacgcggtgttttattacgacgaagaagagaagattgccgatgtagcgattggcaaactcaacattcaggctggtgagaaaatcgccattctcgggcgcaacggcgcgggtaaatcgacgctactgcaaatgctcgccggaatgcgtatcgcccagcaggggcaggtgttgctggataacatcagtatcgggcagcttgatccggcagatctgcggcgagacatggggctactcagccagaccgggcgactgttctttggttcgctgcgggaaaacctcaccatggggatgccggaagccagcgatgaagatatcgaacgcgcgttaaccctcagcggagcgctgccctttgtgcagaagcagaaaaacggcctcaactacatgattcaggaagggggatttggcctctctggtggtcagcggcaaacgctgctgctggcgcggctactcatctctcagccgaatatcgtcctgctcgacgaacccagcgcctcactggacgaaatggcagaagcgtatttaatcgaacaactgaaacagtggattgggcatcgcacgctgattatcgccactcaccgcacggcgatgctgcaactggtggataggataatcgtgatggatcaggggcggattgtgatggacggcgcgaaagaggccattttgcgtgaacagggcgagcccacagcgcgacgggtggtgttgcaggagaagaataaggggtctgcggcatgaacggacaactgcaatataaccgtggtctgactgaaccccgcctgccgcgttcggcgctggcggtacgcgttaccgctgtgatgctgctctgttttctcggctgggcgtggtacttccagcttgatgaagtcaccaccggcagcggcacggtagaaccttccgggcgcgaacaggtggtgcagtcgctggaaggcggaattctgtatcatctcgacgtgaaagttggcgatattgtcgaacagggccagccgctggcgcagcttaaccgcaccaaaacggaatccgacgtccaggaagcgatgtcgcggctgtacgcggcgctggcaacctcggcgcggctgcgggcggaagtgagcaataaaccgctggtcttccctgacgaactgaataaattccccgaacttatcgagtcggaaacggcgttgtacaacactcgccgcgacgggttgaacaaagccaccaccgggctgacgcaggggattagcctggtcaatcgcgaactggcgatgacccagccgctggtaaaacagggggcagcgagcagcgtcgaagtactgcgcctgcaacgccaggccaatgaactggaaaacaaactcagcgacgtgcgcacgcaatactacgttcaggcgcgcgaagagttagcaaaagccaatgcggaagtggaaacccagcgttcggtgatccgtggacgggaagactctctcaccaggctcaactttaccgcgccggtgcgaggcattgttcaggatattgatgtcaccacggttggcggcgtcatcgcccccggtggtaaactgatgaccatcgtgccgctggatgagcaactgctgattgaggcaaaaatctccccgcgcgatgtggcgtttatccacccggggcaaaaatcgctggtgaaaataactgcctacgattactccatctacggcggcctgccgggagaagtggcggtgatatcaccagacaccgtgcaggatgaagtgcggcgcgatgtttattactatcgggtgtacattcgcactttcagcaaccatctggaaaacaaaagcaaacagcagtttccgatattccccgg

SEQ ID NO: 40 - DNA  (genomic), 2643 bp; double-stranded, linear
aaatcagtgaatccccgtttgcaccgaaagaatatgctgcaaactttctaccataatgcgccccgactgaaataagccttcctggatttcgttgttaacattcacagcgtgaaccagggaggctaataatactacttgcaagaaggcaaaaataaacgcaccgataatcataatatgcgtcaggggtattttcctttgctccttcattttaaataacccacaaactggccttctttcattaaggcgacttttcctgtgtgatgataaacaatgacgttatatagacctgactgataaacagtggcatctttattgtcttcatcaattgcacataatgaatcattgagataagcaaagtttttactgctcattctaaaggtcatgccaaatcctttataaatggctttctttgccgcctgggcgtgttgtgcggcttctgcatttttaaatgcctgtgcctcggatgcacttaaaatagccgcctgacgctgctgttctgcgaggtaacaggtgtcatgactgacgccctgcgcctggcaatctgcgatgcgggaagtgggtgaactacagccagccagtaatataaccgccagcagggaaaacgatttaatggagctattcatcattgttaaccttaaataatgtacaaattaatgaagaggtgaacccggcaagcttccttgctcttatttatattgaggattgaaatattagaacgaatatcccacgccgacacctgcgccgaaatcagattgtgtatccgcagaaataccggctttaagtaccgtatgcgttccggcattaaatgatgttccgacagacaccgcagattcaccgttgaaggttcccgctcccgctgacaccatcatcacgtcaccggttttaacctgtggttgtgaggcgatagcgatggcagatgcagttcccgcattggcttctttacgattgtcatcaacttcgttttttagcgaactgaaatggttattgagcgtgttaatttgctggctgttatctgcaacccgtttttgggtgttggttaactgttggtgcgtttgggttacgtcttgtgacaggctgtcaatttgttcatgtgcctgggcagactcctgcgccagactttgcatttgtttatcgtattgagtcctttcattttgctgttgtactgccacatcggttgtcagcgcattcattttctgcccttgttcagtggcggtgcgctgattagcctcattttgagccgccagtctggcattaatcatttcctgataatgcgcggtattttgcgtatctccagtcgcggcgagcgttttttgtgtggctacgatctgcgcctgttgctctgtaatttgcgtttgctgggcgtcagttaccgcagactgtcgggcgttgatcatgctctgataacgggcagttgtctgtacatcacctgtagcggcaacggttttttgtcctgcgtcaggatctgtctggacagtgggagtctgagtggtatcaggtgtttcagaagggatgtagtgatgttcagtcaaataggtatacgcagcggggctgttgtctgtgcgttctaaaaagcgggtaatcttctgctcaatctccgattgcgacatgccagagttaatggctgaaagctctgttgccgccgcttcaatggtatcaccagctaaaacaacagggctggatgttgctgaaattatgagtgccagtaaagctacgtttacagttttcattcattttctcttgttcaaaataagtcgtattaatgtttctataagaaacaaataatattgttttaagaaataaactgcgttgcaatttaatcgaaatctacgccgccatttgtgtgatgtaaagcgcatttttgtctgttgtaagcgtaaacaccatcaataagaaacaaaaatggtttcttatataaataaaaaaggaaatcatttcgtgctctttcaatgtaaaaaagagtaaagacttgttttgataagcgaaataaattctgtttctggactaaacgtgaagcggttcctgatgtgtgctaaaatgcgtttctttgataaatctcaatttttaagaggtttacgccaggcaggaaaatttaaatgaatgaatttgagaagatttttaatgaaatgaatctggaccgggcattgctaccgatcctttttcgttcgaaccggtcgacagtgtggaagtatttaagcggcgatagtacggctcctgcctctgccatgtcgctgattatgctgttgcagttgatacagaaacgaaaccccgatctgttagccgaatggttaacgctttctgatttcaccattccgccagaagtttacctggaccagcctgattactggaaagggtgggtgtatacgcaacacaaggtcaataaaaacgtcctggaatatctaaaaaaacactatccggatgaagaccaaaaaagtatgagtaaaggccgggaagagtaaattgccaatgccagttaacatttaacatggcggaggcggcctacggttttggcgtgatatgacgcgcccgcgtcgcatcaggcgtcggtgcacgactgccggatgcggcgtaaacgccttatccggcctacgattcgggcgcagacttccgggcatgataagacgcgtcagcgtcgcatcaggcgat

SEQ ID NO: 41 - DNA  (genomic), 29 bp; double-stranded, linear
gatgagagcatccggcaatcggcgcacca

SEQ ID NO: 42 - DNA  (genomic), 11613 bp; double-stranded, linear
gtagaatgtagacaaaagcgtggtgtcaaggaggggaggttaacgtcatagtgaagaggagtggtggcaccgatcaggtcatgatgtagtggaagtgcctggaggtgagcaggcagggcaagattacgaaagcccgctccccgcaaagactgacgccagatagtttctgtccatggctgcttttcgcatcttacgtcttaaccctgccttgaataccttatcattcgtcaaaatattaatagcaatgtgccgtatccctgaaaataattctgctgcatttcctcttcttattttgcagtcgtcttcattcactaccacgtccagacgccagtgcagcttattctccacgtgccagtggtttcggattgctgtggcgaacttctctgcggttaaatcagcagaactgatataatatctgaccgtcatttctgactctttcttttgttctgctattattgaccgaaaggagactgccacgcataatttcttcagccctttccattcaaacgtgaaatcaataagttcatcagggacatcgcaaacaatatgaagacggatttcttctctgccgtgactcttttcactcattgcgtaactgtcatgctctggattatttaattctttcagcggaaatttttcctcaaaggctttatttagccgcccctggtttccttttaccgcgaataaataatcacctccctgtttttgtatcttctctgcaatatctttctggcaacccatcgcatcagttgtgatgatttttcctttaatatccagcatgttaagaagttctgggatagctgtaatctcattagatttctcatccgtcttgatctgtccgatgaccagactgtgcattgttgagaacgcactaatgacatgaatcgctctcctgcggcgactcttgtcataagagtgccggagcgtttttccatcaattgcaatgacgtctttatcatctgaagaatggcagtcacgcatccagttaataaagcactcgtgaaattttgcaggactgatacaggatacaactctggcaatggtatcgtgaacaggaataccattttcaaaatcaccatattgcttcaaaaaattgagatgtgtttcccctaaatcctctatatcttcccagccttctgcaccagaaatgacggcacaaatagtcaacagtagaatatccgataatttatgttccactttccaggcttgtctgtaatcagggataatagaaatatgttccatcaattttttaagttccattttgttctccttaattatgtaaggagtatttgatcatatgtaagctgtgaaaaacagttttagataataaggaatatctcaattattgaacatttagtgcgaattatttagtacaaaaaagcggcgttaggtgatctttccctggcctctgtgcgatgtacgccagcggtctgtaaagaaaccgaacaccttataacaaaacctctaacgtagtttataatacatcaggaatattaataaaaccttctgggtcagatatctcaataaatatcatatcaggctcaaaagtttcagggacttttaatttcgctgaaattaaccaaccttgcttagaaccaatactaatagatttatagctgtaattggcatgtagactatttttaatataaggaatttcccttaactctaactcacgccgagccaagtcaagagccatttcgatagttattttgttatgttttatcaatttattagtcccatcatgaatttttctctcaatccctcaacatattttatggcatgagctatttccgcttcattgaataaatttttactttttaatatttcatttagaacgtgttcctccctagataaacgtcctagtgcttcgtatgcttctcgtccaattttcgcaaattgcttagcatgaatcacttcatgatacacctcatataaggtagcatttttcctaagataaatattgcgaagaccataatcaaaagctgccctagcatttggtggcaaatatttatctgctttccttattactttaattcctagcttctccatttctttagcaatattgtttatttgactacgtgataaacgaaccccatccaggaaacccgtatgcccactaacacgacgaccatcgccaatatagtccatcaaactgctgattttagaacttgcagccaatcccagcggatcaacccacccacaaggattcggcacataccggtaagtctgctcccctccctgcaaccccagtggatcactcaccaggtacatcccggtttccggctcgtaatatcggaaccggttatagcacaaccccgattctgcatcctgccactgtcctgcatacagcaggccggggtcggcttccgcgtcccgctccccgcgcgggtccgggtagtctgtgtctgcgggcaggctgagtgccagcccccacaggctggtctgtcccggccgccagacggttttaccttcactgttaaagagcatcagcggacggcccgtcaggtcgttcaccgcatgattcgttcgtgtcacccactgcggggccacggacgggtgcggctgccgtacccggctgcactgctggcttatcagctcaaagccgttaaacaccaggtgccgtacgctgtacagttcatcatcgcggtattcccggatttccgcaatactgtcgccgtcccacaggtacgtgaagcggattttcttccggtcgcagcgtttctctgttcgtctgccgctggcgtcgtggcggtattcccactgctcaccctgtgcgctgcaatacccggtcagctggtcccggctgtcccaccggaaccgctctgtttccgggcgatagccgtcacggtgtctggtgcggctgaccatccggcctgcggcgtcatagtcatactgcgtgtttccggcctgtttcagccggtggcctccggcatactggtcagtctcttcacttatccggtgcccgcccgcagactgcgccttcaggtagccacagctgtcatagccataggactcatcgccttcgccatagcccagcccggtgcctgaggctgtcaccgccgtgacctggccgttccggtcaagccggtactcccgctgtgtttcccgtccgtaatcttcccggctggtgacgcctgatacgttacccgcgctgtcgtaacggtactcccgtatcagtgaggggagcagtattccccatgtggcctctttcggggaatattttccttaccaagaaatatctattatttttttatttttccatctccaagcattatatttgtttgtcacggggaataattcatggccaaaaccttccccttgccaaaacaatctccccgttaaaataaatccactgtaattattaattaaatcataaatcacagattcaattacaaatctataacgaccatcgtgaaatgtttttagtattaacaccctgatagtgcaagttgctttttgtttaccatctacatcattaaaaatcatactaccctttatttcatcagcagcatcttttattttgcatgtgtaatttaattctattttttttccagactggctagaaagatcgagtaggtaaggtttaattaaaagctgataaatattttcatataataaatcaatctctttcatattgccgccttattgttttataaccgaaagtcgttaatatcaatcccaccaaacacatctgaatatatatccactgctgatggttttgttttattaagtgttatatcaaatccttcaataactggatgtaatccatattggtttgtaggagatgtgatatcaataataccggcatctagacgtttggaaccacctgtataatgagtgccggatgtccacttaccatttactttaaatggtccattcgttgtcgcaggaactcgctctccattttttatggctggttgaatctcaactctaaatttactacctgttaattctagtcttttatttatcatgtttatgtatttattgaatgcagcctctgattttatccaatcaccattagcatatttaagtgctctattccctaatgagttcaaaacatcagatatgttgctttgctcactcccccatttcgtccagcgggctaactgacatatagccagccccaaaggatcgatatacccacaaggattcggcacataccgataagtctgctcccctccctgcaaccccagcggatcactcaccaggtacatcccggtttccggctcgtagtaccggaaccggttatagcacagccccgattctgcatcctgccactgtcccgcatacagcaggccggggtccgcttccgggtcccgctccccgcgcgggtccgggtagtctgtgtctgcgggcaggctgagtgccagcccccacaggctggtctgccccggccgccagacggttttaccttcactgttaaagagcatcagcgggcggcccgtcaggtcgctcaccgcatgattcgttcgcgtcacccactgcggggccacggacggatgcggctgtcgtacccggctgaactgctggcttatcagctcaaagccgttaaacaccaggtgccttacgctgtacagtttatcatcgcggtattcccggatttccgcaatactgtcgccgtcccacaggtacgtaaaacggattttcttccggtcgcagcgtttttccgtccgtctgccgctggcgtcgtggcggtattcccactgctccccctgtgcgctgcgatacccggtcagctggtcccggctgtcccaccggaaccgctctgtttctgggcggtagccgtcacggtgttttgtgcggctgaccatccggcctgcggcgtcatagtcatactgtgtgtttccggcctgtttcagccggtggcctgcggcatactggtcagtctctccgcttatccggtgtctgcccgcagactgcgccttcaggtagccgcagctgtcatagccataagtctcgtcgccttcgccatagcccagcccggtgcctgaggctgtcaccgccgtgacctggccgttccggtcaagccggtactcccggtgtgtttcccgtccgtaatcttcccggctggtgacgcctgatacgttacccgcgctgtcgtaacggtattcccgtagcagtgaagggagcagtccgccccatgtggcttccgccgggaaaagtccggcgcgctggctgacaggctgaccggctgcattccagccctgttcacaggcaaaaccccggttactgtgccggagcacttcacgtcccgcctcatcacggctgaacgtcagcgtctcatcccccggcaggataacctccgtcagttctccggcggcgttgtagcggtatgtggttttcagcagggatccgtcggggtgtctgtcgcgttcatcttccggtggcaggatacagcggatgacggtgtgttcgtcggggtagtggtattcaatggcccgtcggccctgagtggtgacattcacccgcccgcgttcatcatagccggtgcgctgtgatgtgccgtccgggctgaagatacccgtcagcctgccggatttgtcatacgcatactgcgttttgccttccggagtgatgacttctgccaggcggcctgcggcatcccggctgtagaggatggtttcctccaggccgttgaccctggcggtacacaggccatcagcgtcataacggtaacgacagaccacgccgccccagtcacgttcttccgtcacccggccacagttgtccagaatataaagataagactcgccctgcgggttaatgacttctgtcagttgcagcgtgtctttatcgtagcggtactgccagcggtggccttcaccgtccgttcgcgccaccggcaaatcaaacgggccgtactccattgtccagacaacgccgttaccgtccgtgtacgccagcaggttgccgtggcggtcgtagcggaatccttccgcgccggttcctgcccgctcaaggccactcagtttatggtgctgctgccactgcaaccgcactgactgaccgccggggccgcgcatcttcaccggcaggtcgtgaccgctgtattcggtgtggtgttcgcggcccatcacgtcggtgagtgtttccggccagttgtggtggtcgtactctatgcccagacgccgttcatcctggcggaatatccccgacagcagcccctgaggggtgtacgccagccgggtctcttcgccctgtggcgataccagacgccgttcatcctggcggaatatccccgacagcagcccctgaggggtgtacgccagccgggtctcttcgccctgtggcgataccagactcaccggcaggccgcgttcatcacactgctgcgtccacgtctgcccggcaggggcggtgatgttgctgagcaggccgcgctcatcatagcagtactgccaatccgcgccgtctgccgccgtgtaacggcttaactgaccgtgtgcggcgttgtattcaaacttctccacccgcccggcaggggagtggcgggccagcaggtgatggaattcatcccattcatacgtggtggtgctgccgtccggcgcttcttcccgcagaatattgccgtcaggatcatagtaataacggtgaatgcccttgccgtccgtcacggtggtgcagccgtcaccatagtccagcgtggcgttgtaatagccctccgccccggtgacggtcacgcaccggccctgtgcatcgtaggtgaaacggctccacgtctggtcgttatcggaccagcggatgatccggtccgcagcgtcgtactcataaaacaggtggtagtccagccgcgcatcctgttcgtaggtcgccagcgtctgtatgccgttatccgtgcggtgaatggctttcaggtagccgctggcgtggtacgtcagtttaagccggatcccgtcggtgtgactgacacccgtgatccggtactgggtgtcgcgctcaaacgtgatgcggttgctggcggtgtcgctcatcccgcccagcatgtacatccggtctgcggggctgtgtgccaggcggtcatcgctggtatcgtcagtcaccgggtggcgcagacgcattcccggaaaggcgtcataaaagaagcggctgctcagtgcatccctgtcgaacagctccagataatcatcacggcggcgcagaatgtactgggcgtgatacgggttaaccgccgtatcactttcaccgtcgaaggcgaagttcagcgtggctcccaggctgatgacatccacccggtttccctgttcacgcacccaggcgtattcgctccaggagtcgctccagcccacgcccgtcaggccatgcagcggcagtacagaactgtggaaacgggtgaaggagagggggagtgtctggcccagcgtaaagtcggtacgttcgtcgcagtatgcgccggttaccggatcgacaggatctgttacccatctgatgactttattggcaatactttttaacgaattacctgttttccccagcaacgcgccgagctttgcgcccagcagcttaccgcttttccccagcaggtttcccagtttgcccagtttcgccagattccccagttttcccagcagtcctgctggcggcagaagatagctggctatcgttattcctcccaggatcattctctgccatggcgggaactccggctggatatccagataggtgacctgctcacccccaataaagacgtccggcgaaccttccacgattgccgcgctgcactccagtttgtcgcccttgcgcgcggcaggctgattgttgataaagacgttgctgctgccctgggctatcctcggtggtttgttctccttgtcgcagagcgccgtgtcctcaccggcttccgggaaatccacatcttttttgatttcgccacgcccgcccaccatggtggcaaactccattaataccggaccggcgggaaacagaagcgatgcgccggcgctgacgcgatccataaaaccggcattgctgtccgtcagggtgataacagcgttcccccaggccttcgccagtggtactgctttttccgctgccgattcaagcaggtcagtggcaatatcaccccatgagggttccccctgtgggacttcaggtattgctccaggtgggggaggagggggaagggtgacggctgcacgggctgctggctttccgttaatttttacatttttagaaccggtattgatggcgccgtccgtgtcacaaaagctgtttatccatgattcaagctggttctgtttctcctccacataatcactcgccttatagctggcatacatcagcgcaggcaccagaaccagcgcataagggccggtggcacaggcggccataatcaggcaaccttctgctatggtcactatcgcccccagcacggcccctgccagcgcccccaaaaaactcttgtgctgaatttcatcgcccagcctggcggcgggggggccagacttttttgatgccaacatctgtgcaatggctttgtcgttggctgcccgtttcatctggctggcggccatcgcccgctgcgacagcatccgcattgccagcgtaccgcctgcggtcgctccctgtggcccgcctggtccttcactcatgttttatccctcgtttatgtcagcgcggctggtccttttggatgtcattctccggtggcaacggggtgaagctctttatcacctccagcagcatcgtcttttgactgttcttcagggataaggaggtgctgaaagtgaaggtcagcagcgtatctccacgccgctggaatacggctatctggctaatccgcccctgattcccttcatcttccggaccgttccaggaataatccagcagccaggccggggcctctgccagagtgatttcccggcaggcatgttcggtgtacccatcaagtttgccctggtacagcgccagcgtttcctggtacagctctggtgtcagggttccctgtgaaacgggttcgcgggtaatgaccaggttgatgccactgttatccgtggataccaggacctgcatcgactgatcctgccattgcgatggcagttgaatatgaccttcattaaaagtgaactgcataaaatactccctgttaatctgagtgaatcagttgatgaaaacagaaccgcccacgatggtgatgccatccttcgacagcctgattaccgttgattccccgacctgtagctgaatgccatccggcgtcagcgcaattttgctttcctccacggccagcataatttccttaattgccgtataagcctgtataccgttgccttcgccaccattgtttacagcgtcaacatgcaccgaaccggcaatcgtgcctctgtcctgaaagacatcctcagataaagaccctttcagtactccggtgatcttgtggcctttttccaccgtaagaaggcggttaccttcctggatcgtgaccgtctggtcattttttacggtttcgcgatgatcgtgttttacggtggtggtacggtcgttgagcacttcggtatccatgttcttctgcgcgtggatgtagacctgttctctccctgtcgcatcatcaaacttcagctcattaaacccgctgcccatatacgttttggaacggatggtcatctgcgtcttcgtccccggcaggctgccgggggtgcggttttcctggtggtaggtgcgccccataatgatcggctggtccggatcgccgttgaggaagtccactatcacctcctgacccacacgcggtatcgccaggttgccaaaaccggtgcctgcccacgcctgtgccacacggatccagcacgagctgtcctggtctgccgggttataacggtcccagttgaatttcacccgcactcggccatgttcatcacagaagatttcctcaccctccggccccgtcacgacggcgctctgcggaccgtccaccagcggttttagccgcggctggggtcgccatgtccggtctgccgggatcaccgcaaaatggttctccagcgccgtccctgctccccgccttcccggcaccgcctgcggctgctcgccgtgcagttcacttgccaccacctgccattcccggttcaggttcgcctgcggatgccccgtcagcacaattcgccgtcccggccatatctccggcgagcgactcattccccgcgcggtttctgcattgtttcgccagccctccatctgccagcgggcaaagttctgcccgtgggcgcccttgaaacgtccggggtagtcatacacctcatactgcgtgcgctggtaatcctggtgctggccttcctgatcaaaacgtcctgcccagccggggcgtttaaaggtgtagtctttggtcaccacggaagaagggcggatttgtgcgctgtagcgaaactggctgatgcagagggtgctcacctcggtacgggtgttcgggttccaggggatttcaaaagattcgggcagatggcggaccgtgtcgcacagcaccaggctctggtcggtacttttgtaagcatgctcctcataaaagaagatgccttcctccgccgccatccggcacaggaaatcgtaatcagtctcaccgtactggacacaaaactcacgggaaggatgcggttcactgaacagcggactccactcggtcaccccgttttcctgcaatatcgtgccgaggatgcttttgatgtcctcgttctggaagatacggaagttctggcgcagaccggcacgccacagcggcgggtgcaccttcatgctgtacagcatctggtttttgtcgttctcccccagttcaaaccaggtcaccacacctttcacccggcgctgtacatcatcaccctgccatattgtcaggtaggccattttgtccagcacctgcgcaaattcaagggagagaaactgctggctgaccaaggagagatcgagggaaaagagcgaagagagtgactgggtgagatgaaaggaaaccaccgcaaaagcgtccggtggcaggccgtccacttccagtgtgaaacgtaatccggttgacatagcaacctccggtaaaatgaataataatccgcaccgtacaactgcggataatgagataagcgggacgacttaagacgttattagggaaggaacaaaaaatgctatgattatgtgaggattttgtttaaatattactttacagaaacgggtgtctgttcagtcaaaaaaataatcacaagctcaacttattgtttcctgacgttattcaggacaggtgcgcacatcacagcgagtaacaaaaacgcaaagttaaaccaatattcataatatgtttttattcacaactaaataacccaattaacatcattaaaatgaatgattgcttaaaaaatatatgctaccgctccaccctgataacatgatctgcacattgcacatcttaacgttgttaaatactggctcaatagtggatattttaaattaggaatttatcaaattcactttataaatggattgggtgaataatataaaaattaatgatgattaatcgcgatttaattattcattgctttatatgataggtggcttgtttataatgatggaaatttagcgaaaaacgccgtaaaccctcgccctgaatttgaacttaataatcaccccctctccggcaacaca

SEQ ID NO: 43 - DNA  (genomic), 491 bp; double-stranded, linear
cgcatatccggttgtcaggtcaggatggtaaggcacctgctttacactttcgcccgcggtcagtgatggctgcgggcgatttcgttttaagagcaatgatgagttttgccgacagaagtccgaaacaggattcactgtataaataaacagctattttgctaaggaagggtaagataacggcgggtgcctgaagctttccggtttcaggttaactctgaggtctggaaagatgaagccccaggagatatttctatcaatcctggggctgccactccgagccccaacaactcggatggtagtcccttcttcgcatggaggcaatataaacatgctgacgaaatatgcccttgtggcagtcatagtgctgtgtttgacggtgctgggatttacgcttctggtcggagactcgctgtgtgagttcaccgtaaaggaacgtaatattgagtttaaggctgttctcgcttacgaaccgaagaagtagccgttgtgcg

SEQ ID NO: 44 - DNA  (genomic), 30 bp; double-stranded, linear
ggatgattttaatgatgggtaaaaataaga

SEQ ID NO: 45 - DNA  (genomic), 520 bp; double-stranded, linear
tcgtcatacttcaagttgcatatgctgcgactcgaattatgtagagtttaaaagggttagcagtatatgagcaccgagggatacaggtattaacctgtaatgcttaaagtcagggagacctgtacgctggggtgccctttagtcagaagactagcgggcattaaagaaatgaaagtcaaaactattacgatgggcaaacttcatgatatgggttgtccgccttatatgaggcattaagcggttattattttccatttacctttacctcttgctgtgtcagttgaaggtagagttattctatccatgaaatggctataatctgtgaagaagatcaacaaaaaacgatcataccccagataataaatcattaattatgaatagcgccatactagatgctgttttgttacttaaatgttgtaatttcgtgttttatatttgcgttaagaaattaaacctgccaaataataatatttggcgcaggtttaataataaattaatcactatttaggcgaatttattg

SEQ ID NO: 46 - DNA  (genomic), 1403 bp; double-stranded, linear
catgttcttaatggatatccaggtacaccagaaggtcgatttggaaaaatggattccgatggtaagaatatcatatattctgaatgtaatgttttacccacaacttttgagattcgataggtgtagaacatgagaaactcactaatattacttattatgatattgtttacaatatcacactcagtatttggaaaagaaaatccagtggaaatttaagtaaatagtcgtgaaatggctttggaattatcatatgtttacattaaatatgtatacgggaaagaaaaagcagaatttcagaaaccatatagtattacagatgacaataattgttggaaaatcgagggaaaacaaccgaagaattcaggaggaaattttacaatgctaatagcgaaaaaagatgggcaagtgttgaatgtaatacacacaaaataatccactgtacagtcgattcaaatattttaccaaggtgtgtttcgtaacaattttgtgtacaatatgactctacatatcgacgaaaaaaccacttgatttgacaggaatacattcaaaaaatttcttttttcatttcaggagcgattttcatctgttacttgaagtatctgtgagattaagtgactccccctaacgtcgtactaaatagtaattactggccataccgggagcagtattcggcgctccccacatgcagcagaataaccgcatcagcgaagatgtatttttactatcacaatgtgtacggacggtttatggaaaagaatgaacattagatacgcgatgcggcggcaggttacacggttatcactacgatagccaatactggctggtgcattaccgccgtgaacaataggacgccgtactgctggaaatttcttacctttataactccccgcgccgccgtatcgggaaacgggaagcaatcaagatgaggctgatataatgtgcggaatgcctgagtatttttagaataggggggtaatatgtttgatagaatatatcttggtgatcgagcaataaaaaaattgaatttgatttatggagtaaacaaattagaattcaggttaatttaatctcaaggatagcctatggtacaacagaatggaatttttatgataatgaagacttagaagatggttatttggtattttcaggtgttagtttcttcaatataactcctaatggctctattccaaatgattatataatttcaataattacagataatgtcaatgttgaatattttgaatcaactatagtttcagttggacaaattccaaatacaaattcttgagacattgataatattggtgagtgtcaaattttcatcaggtgtaaacacagctggattgagaataaattcaaagaaaaaataattgaataaccatgttatgtataggcattttaga

SEQ ID NO: 47 - DNA  (genomic), 70 bp; double-stranded, linear
cgctgctttgatgatgatgtaaaatgattgtttttgaactggatataacagcttggtagggaagaaagca

SEQ ID NO: 48 - DNA  (genomic), 13965 bp; double-stranded, linear
cttaaacggttaaccacggtcgaaatctgactgcaggcttgactgcatgaccacagccactgtggattgccgcaaccgaccgcaagccacgaataagaacgacggcgaatttcgaatcgttacctgatgcactggcttcccagcgtttgaccgtagcgttaagtaaatcaacaaaagcgatgttcaccgcttttcgtcaagtcgtgccatttgtcagccaggatcgggtctttaccccggatattgcagcatcgcaaaaattcttagagggatatgctataaatcaaaaataaaatctttgttgattgtttatcataatatccacagatatgataaatgatatcaatttaataattttcacttaatgtgattccggataattcgaaaggcgctgtgcttttcggattattattatctgattaagatatttgtcacgccagccttactggtttataaatgtcaatcatgattcttataaattatttattgctgctttggttaccattacttcgtaataagtaatgtatttttgatggtttaaactatttttaagggacggcattatgcgagggaaaatacctaaaacggaactgctggtgacttttgaggtcgtcgcacgtcatgaaagttataccagagcggcagaggagttagcgttaacccaaagtgcagtattcagacaagtaagtgcgctggaggaatttttacgtactccgttattttcacactctaaaaaacgcatttttcttaatgatacagggaagtattacctggggatagtaaaagaaacattaaataagctggaacgcgataccaataccattatgacctggcagcctacggttcaggttattgaacttgccgttaatcctacttttagtacccactggttaatcccaaatttacatgaattcacaaagttacatcccgatattattgttaatattcattctttagctaataacggcgattttcttaatcgggagtacgatgctgtcattatgcgcgaaaatttttgcgcgccctgggcggaagtagaatatctctttgaagaggagattttgccggtatgcagcggcagtttgcttgcaatgtccgatcaaaaactgtcagtggcagaactgcttactgagttaccacttctgcatcaaagcacccgtattactggctgggaagagtggtttgctttatctggcgttagcagtccgctggtcaacaacggaccacgtttcgatttgctttcaatgctgattgccgccgtgcgctctaatctcggcgtggcgctgttaccacgtttcgctattcaacatgatttggatagtggcgatatggtgattccctgtgatgtgcctattcgtaccggtaatcgttttattatgacgtggcaggaagagaagtctgactcaccgcacttgcagcaatttcgtgaatggttgctggcgaaatcggtcgtaccgcaggagatgtaaaacctgcgcctggcgggatgccaggcgcagttattaccagtcgatacccggctgggcctgaatgccgttatcaaaagcatgtttgacggggcggatttcgctgaccgtatctgccatttttaatatctgactgtggcaaccgcgtccggtgacaatgacactttgttgtgccgggcggttttgcagagaagcgatcacttcttcggtatccagataatggtaagccagcatataggtcagctcatcaagcaccactaagtcgtaacgcttgtcagccagcatccgtttgctttccgaccagacctctttcgccgcgtcgatatccgcttgccggttctgtgtctcccaggtaaaaccggttcccataatatgaaactcaacccccagcggctggagaaggttgtattcgccgttgtcccattgccccttgatgtactgcgcaacccccaccgttttgccatgacccaccgcgcgcgtcacagtaccaaacgcggcagtggatttccctttgccgttgccggtgaaaacaatcaagatcccttttttctctatcgccgccgcgacgcgcgtatcgacctgttccttcaatttctgttggcgctgcacatgccgttcagttgaaattcgcgcttccattcattttccttaatgtcccgcagggcaactggcgcagcggtgttgctgctcaaactgactaaagaaattattgcctttatcatctaccaggatgaatgcgggcagattttccacttccatcatccacaccgcttccatacccagctccgggtattccaggcaacgcagacttttgacatattcttgcgccagtaacgcagctgcaccgccaatacttcccagattgaagccgccatgtttgtgacaggcatcggtgacctgctggctgcggttacctttcgataacatcactagactgccgccagccgcctggaaggtatcgatataaccgtccattcgaccgcccgtggttggacccagtgaaccgcaggccatgttctccggtgttttcgccgggccagcgtaatagacaatatgatgcttcaggtactccggcatcggttcgccgctatccagccgcgcttttattttggcgtgggcgatatcgcgcgccactacgatgggaccacttaacgacacgcgggtgcctactggtaatctggcgagatcctgcatcacgtcacgcaacggacggtttagatccagttgtacatgttgcgcgtgattttcttcccgcagtgaggctggaatatattgccccggattgtgttcgagtttttccagccagataccgtgtttgttaatttttgctttgatattgcgatcggcagaacaggagagcgccatagctatcgggcaagagccaccgtgacgcggcagacgaatgacgcgaatatcatgagcgaaatatttacccccaaattgcgcaccaataccaaattgctgactggcctcgagcaacactttttccagctcaatatcacggaatgcttgtccctgctcgtttccgctggtgggcaaattgtcgtaatatttcgttgaggccagcttggcaatttttaaggtttgatcggctgaaagccctccgacgacaaaggcgatgtggtaaggcgggcaggcagcggtgcccagcgatttcattttttcgattaaaaatgcggtcagtttttctggttgcaataaggatttggtttcctgataaagcgcggctttattggcggagccgccccctttattaacacagagaaaatggtactcatcaccagcgacagcgctgatatcaatctgcgccgggagattggtttgcgtattgacttcggtatacatatccagcggcgcattttgtgaaaagcgcagattattttcctggaaagtactgtaaatgcctttacttaaggcttcggcgtcgttacctccggtccatatctgttgccctttactggcaacaatagttgcggtgccggtatcctgacagttgggtaataccccttttgctgagacttcagcattacgtaataactgcaacgcaacgtatttatcattactgctggcctgctgatcgttaagaatgctggcgacctgttgcaaatgagcggaacgtaagaaaaaagaggcttcataaaatgcctgccgggcaagcagcgttaatgcttcaggagcgatttttatcacttcttcgccgtctaattccgttactgtaatatgttgatcgctaattaatgtatattctgtaccgtctttattttgtagaaacggttcttgccagataaatggtttggacatatttcacttttcaccttaaacgttagtgttacttaattgccgtctaacttcatgatccggcttataaaaatgcgtagtcattggcttctgattgcttaagatccccctcagggcagagcaacgttcgattcattgggttttaatgctttaccccgacagccctcgccgaaatgttcgccttcccaccgactcaccatcgcagcgcccattgcgttgctcatgacgtttgtcgcggaacgccccatatcaaggaacggatcaacgcccatcagcaagatcagccccgcttccggaatattgaactggttgagcgtggcggcgataaccaccattgaggcgcgtggtacgccagccattcctttcgaggtcaacatcaggatcaacagcatggtgatttgctcaccgatggataaatggatattgcaggcctgggcgatgaaaactgtggcgaaggagcagtaggccattgatccaacgagattaaatgagtagccaatgggtaagacaaagctggcaattttgggggaaacgccaaattgctccagtttttcaagcgttcccggaaaagccgcttcagaactggatgtggtaaatgccagcagggcgggttccgaaagggcgcgggtcagcgtctgatgcaggggccgacataaacgatggccagaccgataagcagtacccaaagtaataacatggtgaaataaaattcacccataaagatcccggcgctcaccataactgccagtcctcgttcagcaatcaatgctgaaatagcagcgaatacggtcaggggagcgaagagcatgacgtagccagtgagctttaacatggcatgtgccagcgaatctaaggcgtgaacgatggcgctgcctttctcgccaatcgccgtcaggctacagccgaggaaaattgagaacaccacgatttgcaaaatttcattgtgcgccatggcatcgacaatgctggtggggaaagcatgcgaaataaatacttttagcgtaaagggttctgccgcgaccactccggtggtttcggcaccgtgtgcaacaaaattaattcctgtacctggcatgaagaaatttaccgttatcaagcctaaggcaattgacagcaatgaggcgcaaataaataaaaagagtgttttagaaaaaatacgaccaagggctttggcatcgcccattttagcaatacctaccaccagggtagagaccactaacggagcgataatcatttttatcagtcgtaagaaaatcgtcgtgaatatcgatatttcttgcgcatagagttttgcggtttccggtgaagcagtgttattgagcactacgccgataatcattccaagtaccagcgccaaaagaatcatcgtggttaaacttattttcttcattttttcctccatcaggtgcacggcgataaatcagaatcaggagaagtagatgcctgaatagagattcaggcatctacctgctattacaaccttacaaatagctgaagtgttgaactgcaataagtgacgggatgtcagttggctaaaagtattcggatttttacaaatcgaaactcatatttaataaaggtgcatgttgctgtgcaccatagacatcattgtcacctacattcccggagataatatctcgtggcatgacgatttttactgcgttagaaggatcaaaccagacaatacgatgaataaagtcaggttcaacatgatataagcgtgcaatcagttctggggttaattgccctgatgatttaactcgctcatagttttctttcgttttaaataaaatatctaaaaccagttcgtaaggtccggcatttttcgaacgaatgacttgcgccagtgagacaattgactgtttcatgcctgaactccttctggcgtcacctgttcaatatggaaatcaaaacgcagagcgtcgttggcttcaatcaggtgatatatggaaaattcgtataccggcccgccctggatatcagaaggggagaacgggaacgccagattacctgcggtagcgatgcggttttcatagccgtagtgcagcatggtagagcgcaccagcgagcaaacgctgttggcaatttcctgggtcggtgcaactacatcaaggacaatccccagctcatgcccggcagtttgcatcggttcatggtctcccatcaccccgtttttgccgtacaggtggaaattgatgcgaatgctgtcatcgtcgagcgacaggttacgcgaaacgctggttttgacttcatcgatgattttatcgatcccggcgatcataatcgggtcgcgcgttccggcgatggtcagacagcggaagcccacccgtcgtgcaccttccagtttcagggcatacggcgtttcttcatgcttagaaccgctgacgtagacttcgccgtcatttactgctttaaatgtgcagcctttcaggttcaacacgccgccaggtcctggcaggaagtagggatcggatttctcatacagtgtgtgtgcagctgctgacgtttcggtaaatttacgcttcggattaaatgttttcagcgtaaagccgttgtcatcaatgatgcccatcgcacagtcagagcctgagccgggcgttgcggcgattgccgcgcattcaaggattttcccacaatgcagcgccagaccttcatcaaagccttgcatgatcgggagcgcagcaaagcaggccgggtcgtaagcgcgcccgcccagcaccacttgcgcgcgttctttcagcgcccgctggaagggttcgatgcccatttgcgcgacgatatacgtactttcgtcaatcgcgtcgtgggttaacggcgggacaaaatccagcgccgtgattttgccgttatccagcgcctggtggacgatggctttgtcaacgtctgccgggatcaacgccatcgagaacgagaggtgctcttcccgggcaatctcatgaattatttctcggcaccactccaggtgtggtgcggcaccagaaccgccagccgttccgatcaccaccggtatattattttgcacgcctgcggtgatcatatagcgcagatcgcgcttgacccctgcgcgatcggtaaacggtttgcctgccccgaggtagtgggggcctggatcggaagagcctgcatcaacggcgatcagatcgggcgattctgccatcgctttgcggaagctctcttccgggaatccatacccgaggattgccgttggcgataagactttaaaagaacgagccatttgttaatccttagcctgcaacagcgcgatagtacgattcatttcgttgaagacgatatcgaggccttcgtcaaagcccatccctggttttaccagcatacgcatggggcgagcggcaagggcgacgtggacacaggtgcgggcactgacatcagtttcattgcaggtgccgccctggtacgcttccatgctgtggctgttgcagtaaagaaccgcatcgacgatgttgtgaatactgcccagatccggggttttgatttgcaccatgtgacaactggcagcatcagtgaaatcaacaatatcctggtaggtgttacaccattcatcggccacaattttcacgccggaaccgaggcgcgtcagctctttggtaatcgcggtcagcaggcgaatttgatcgggcttgttaccggcatcgaccggcccttcgatgtagagcggcaggccttgcgcttctttttccaggctggcgatgtattgcgcacagcgaagcggatccatatcgaagatcagaccgatagtgccgtatacatcgatgtgcagggtagggtggtagcgtgcgctggtgcgcttgcttagaatgcgatccgacaaccagcggacatattcgcgcagtttttcacctttaaagcccagcttctcttcgacgttattaatcagcgcatggggcagcacgtcgatgcctttaaggatcatcttatcgacggcgatatatcgatcgtcgccgctctgaccaaataatggaatggattccgccacgcgtggcaactgccattcatcacagaccacttcagttttcagacggccggttgccagcgcggtagcatcaagcagcgcctgtgataatccgtagcgcacggcggtatgcagcaagttgccgtcaatacgcaatttgtcgaagaaacgggcattcggcaggaaagcatccacatcgcggcctaccagtaatggcttgatatggtcgttgaggaacggaataaagtgctctgcgaggaacagtggatcgcgaccgcctgccccggaatactgtacggcagtacagtcacctacggcgaccgcgccgttttccagaatcaactgtaccgatacgcactccccggcctgacgtacggcgttaaacccctgtgttactggctccccggtataaaaaaagccgtcatgacccgctccgttttttatcgcctgctggtcatcgaaatagaatgaggagtagccagcggtgaacagagcctgttttattttcattatggtcttcctattaatttactgtgggatacagcattgatgtcatctacaaccatctggaatgtcggttggcgtccttcacagcgtgcgcgttccgcaacgtaatcgtggtggaggtcgagaatatcttttggcaatggaacggctccggcttccagtacgcgtatcgcgccggtgttgtcacggaccggaagaattttgcccgcgttgcaggcggctggcgcaaacggcacatccagtacgcccgcttcaaatgccagcaccgttccgcgcgcaatatcaccattacccagttcgaacactttattcagtaccgcgcgaacctcgctcttaatcagttcaatttccagttcaaccgcagggcacggcgggaatttctgctcattgaccatgttgagcatttggcgggaggctttcagcccctgaatgttggcagcggcagtcgggataccccaggcttcgtgcggacttttggtgatgactttggtggcaccagacatccccgcgacggctgcgccccaggagataatagcgaacgctttcgattcgtcttccggaaagccgcccatccactggtgaaacacggtactcaattcatagtcggtatagccatagctctgaaaatattcgtgtgcaagttcacgcagagactggatcgccgcaacatcctgcgtcaggctgccgacctggccataaccaacggtgatagatttcacaccctgttccagcgccagcaagccttcgattatcgcgatagagtgcgagataaacggcgggatcagcgtacccgttagtgggccaaacggttcgcggttgatgcggatcccgtgttcttcatacatccccattaaacggtcgcagtactgccagtcgcggatcgatttttccagcgttacgcgtttggcatacggaatgttgtaggaaatgccaccgccttcataactggtaaagccgctggccattgagatttcagccagcagacgcgcatctggcgtgccgtggcggatctgtagcggtttttgcagggtttcggtgaggcgacggcaagctgcgacaccatggttaactaccggtaaaccgttcagtttagaggttccggcttcgatggattttttaatccctacagccgcttcttcgtaccgattcagacgggtatatgcatcgatggtgcttggcagcagatcgcactcttcttgtagtgttttcagcagttcgatgtgttcgtccatcagcgccacacctgcgcgcggttggctaagggttttaccttccttgtctgctttcagcagcgcaagagagaaacgtttatgctcagggatggtttgttggtatttaacgccatcttcaaagttttcaacatccttgccggtttcccaggttttcagtacctgttgccgctcggtcatgaattcgtcatgggttaatttcttatttcgaagttccattgattgcagccttaattgttatagggttaagcattgaatactggtgcgcgcggcggccagcggatcgactctggcgacgtttgccagcagtggtaatagcccccgggaatcgcggtaatattcaaattcggtcggtaagagaatgcgtttaccgtcgtcgtttaactcgcggtatttcaaccagtgatgcatatcgaactgactggcacgcgagagccatccgccggatccgacgactttacgcacggttgtcaggtcacgtcccatctgtaaatcgacattgccgacgcaggtgcagacctcttttttggtgcccgcatgtctttcggtggcataacccacacacagtccggccaggacggtatcgaaatatttctcttctgcatttgcgggtaagtagtcgggatgagcgactagatgacggaggtaatgataaaaagcgtccagctgtgcgggttgctgagcaaaattcacattgactaactctttcgcactttcaccaaccaccactgccgagacgcgcattcccagatcgccttccaccgtccgttttacgaagggttccggtacgccgtgtaaaacggtgtcgggcgagagcgtgttggcacaggcggaataaacatcggtggttgcgccgcccatgtcgatcagcatgaactctttccagctgtgatcgacgttactgattgccttgaccagttcaaagaccgtccatggtgtcggcattggttcttcgcctgttttatcaacaatgacatccagccctttccctttaacgatgcgtttaaggaatatgtcgcaaatagcctggcgtgcagctacagggttcggatggtcaagatcgggcagaacgttgtcgacaatggtcaggtctttatgcccgaggatctcctgcacctcgtcctgaatatcccggtttccggcataaataatggcgcagtcgagtttggattctgccagcacacgggcgttattcagtccgtagctttcttctccgccgtcggtgccgccggtgaacaagagaatatcgggctgcgtttcttccagtgcctggatatcacggcggttcagcttgtaggcgtaatattgcgcaattttagcacccgcagagtgagcggttactttcgcggtttccagggtgatagaaggcaccaatcccattgcggcaaccgccagcccacctttggcagaggaggaatacttcaatgcaacctcaccgctgtttaacagggggagggcattatctacgtttaacacctggttcaggctggagaaaaaccccttcgccagatgatgggtggtggttggggtcagtacgtggttaaccaacgttaacgcgtccccctcccgggtaaagagggctgctttggtccacgtcgatccaatatcgacagagacgatttgcatcagatagcctcttcaagaatacgagtatcaacgtcatgacgttggttgatatcgtgggccatcagctggcaaacatcttctaagtcatgacttggggcaaagacgcgatcaaatcccatctctttgaatttggtttccacgtcagcgaagtcatgttttccgaccaccaggttaccgcccacatagagcaggatgtcccccagtccacgctcgatgcagcgttcgcgcatgcccagacagtcgatatcgccatgcccatagatagaggagacgacaatcgcgtcagcgccagtttcaatggcagcatcaatatattcgtcctggctgaccattacgcccagattaatgactctgaagtcgtggttgctaaaaacgcggtccagaactttattgcctactgcatggcagtccgcgccaataacgccaatcacaagtgttgctttcttcatgggtaatcctttgtaagacagagagtaaaataagttacacacgtcgtatttatggccgttcataacggcacaggtttaatatcacaggagtgtctttatctgaccgtaatgttgcaattgatctattttcaaaatgtctttcgggaaatgattgtttgaagtgtgtttttaaatttccatgttaattcagtgtgttatgtcaactaatgtcatgagtgttaaatttttaaaattaacttgatttaatgtattgagataattgtgatctacttctaatttgcatttttgtgacgtggttttagccatgagtaaatgcatttcataagatttaagtcgaatttcactgcaattcatctctgcttaatgtaaaaataatgttgaaaataacaaatggttaatgattcatgcgaattatgaccttagttagctcttttaatttttcgtaaaaaagagaggtacatgaaggtgctatcagtatgagtaacgttaatcaaaggttttattacgtctggcaataacgcaggccatttttcgcgacagggtggatttaatcagtataatcctcatacaatagttcacgattaactgaaccgttaacggggatttggtgttgaaatttagaaatggcggagtcaattaatgaagacaatatcgaaaaaatgactgtgtcagaattaatttcaattaatccttctcgttgttgaccaaaaaagatatttatcttgatttcatttgtactacggcaatcaatatgtagtaatttttgatcgctgagattttctgtttcataaatgtttttggcgagagtcgggtgtattgatgccagacatctgctcagataagccatatcctttagggaacaccccgctgagtagaggatgtcagagaatttttgtgtgtcaactgttgtctctgaagcgtatgttgcattgactggaagggtattgaaagagatctgagatggtatcattatttaaatctttccgtgagtaataaaaattaatccccaggcattgtttagcaatatttgccataggggatatatagaaaattaaagtattttattggcttcggttaactgatctataaccagtgccagattggtaaacattttgaaaaagcgatactggctcggaatatctctttcaaagacgaaacattcaatgtcattgtttgaaaaataaaggactagtgttgctgattcgtcagggaaaacatggaaatgtatctggttaccagaaggaggatagtccagaagaagggtatctttgcccgtcacatacctgttgttgtcgtggacgctacgctcacacttcatcagaggtgtcaggatactcatgtattcatctgatgttaatttattaaaatcatcattcattttaaagaaacgataaagtaacagtacatcctcttgcgtaaccggttcgtttgtttttagagggaaataagcgggaaccagaagatgaggttctaatctattttgttgagcgctataactgaatttgaacataaattccggatcgctcatcaattgagcgacataattatgcctggcttcgaaaattttaatttttatcaggttaaataagtctgtttcgtcatcctgtattacaagacattggccatagcagccaggttttttttcattataagcagaaacggttattctgtcagaggtgtcaacgttatattcaaaagccagatagtgactttcttcatcgcgatttgtttccagattatttaaattcatcacatgaagtgtttgcaatgctgattcaatgagctgttgactctctgaggtaaatgtttcgcgctgcgttgtataaagtgtatcaattccaacgactatccgatgtgggtcaaggatggcggcaatcatctttattacctgcacagtcacgggtgatgtcattgattctttatctgtttttagagaatcattagatggccaacctgagaagcgattgacagccgaaccgatattatcaggactcatagcagcaacctcattgtaatcaagcgaggcgctgagcgtactcggctatagaaaaactaacttgcaaaaatcgctcatttttcatttatcaggcgaaagtggcctctgttcactcagaaacaatcactcccggtaagtcatacctgtttcatcgatacatttaagtgattattactaatgaaacaataacataacgggcttacggtcggtgctcataaaggcaacaatcaattaactttgataaaaatatgttatgtaaaatagcaacaaattggctactctaatcaattggtattataaaaagtggataaggcggttctgttaaataaaatactggttttttatctataccttttcattgtaataattgtgttgcataaatatttcacaataaattaacaataaaatcaccaatgatctatgg

SEQ ID NO: 49 - DNA  (genomic), 49 bp; double-stranded, linear
ttatcattgtcttttcctcttttgatgaaatggcaacgatagaggcgag

SEQ ID NO: 50 - DNA  (genomic), 38584 bp; double-stranded, linear
gttttttatactaagttggcattataaaaaagcattgcttatcaatttgtgcaacgaacaggcactatcagcaaaataaaatcattatttgatttcaattttgtcccactccctgcctctgtcatcacgatactgtgatgccatggtgtccgacttatgcccgagaagatgttgagcaaacttatcgcttatctgcttctcatagagtcttgcagacaaactgcgcaactcgtgaaaggtaggcggatccccttcgaaggaaagacctgatgcttttcgtgcgcgcataaaataccttgatactgtgccggatgaaagcggttcacgacgagtagatgcaattatggtttctccgccaagaatctctttgcatttatcaagtgtttccttcattgatatcccgagagcatcaacatgcaatgttgtagggatggcaatttttacgcctgttttgctttgttcgacataaagatatccatctacgatatcagaccacttcatttcgcataaatcaccaactcgctgcccggtaacaacagccagttccattgcaagtctgagccaacatggtgatgattctgctgcttgataaattttcaggtattcgtcagccgtaagtcttgatctccttacctctgattttgctgcgcgagtggcagcgaccgggtttgttgttatatggccttcagctattgcctctcggaatgcatcgctcagtgttgatctgattaacttggctgacgccgccttgccctcgtctatgtatccattgagcattgccgcaatttcttttgtggtgatgtcttcaagtggagcatcaggcagccccctccttattgctttaattttgctcatgttaatttatgagtgtcttctgcttgattcctctgctggcgaggattttttcgtagcgatcaagccatgaatgtaacgtaacagaattatcactgttgattctcgctgtcagaggcttgtgtttgtgtcctgaaaataactcaatattggcctgtattgcttcagtgattgctatcctcctgtctcggcctaaaccaaactctttacccgtccttgggtccctgtagcagtaatattgtttcttatataaaggttagggggtaaatcccggcgctcatgacttcgccttcttcccatttctgatcctcttcaaaaggctacctgttactggtcgatttaagtcaacctttaccgctgattcgtggaacagatactctcttccatccttaaccggaggagggaatatcctgcattcgcgcacccatcgacgaactgtttcaaggcttcttgggcgtcgctggcgtgcgttccactcctgaagtgtcaagtacatcgcaaagtctccgcaattacacgcaagaaaaagccgccatcaggcggcttggtgttctttcagttcttcaattcgaatattggttatntctgcatgtgctatctgcgcccatatcatccagtggtcatagcagtcattgatgttctctgcttcgataactctgttgaatggttctccattccattcacctgtgactcggaagtgcatttatcatctccataaaacaaaacccgccgtagcgagttcagataaaagaaatcctcgtcagtgcgaggatgctgttcattgctgctatacacttttttgctctcaacgtaagcggtagctcattctgttgggttggtgcagttgcttttaggaaatgctatttaccccttaaacgtcggctgaaagagctaaaatccatgcaaaaaatttacgcaattttgtgtattattgtgcagtaagtaatgagctattttctgcgcaaaaaatggatggtaaatttgtccggggcaggaaaaattttatgggcgctaaacatgaaaaaagattcgtatccttatttgatttgcatgacagttttaggcctgatctttattttccttttcttctggtggcgggcagatatttacagggtcacgtttcttaatcagagtatatcccactattacattctgtttagcatgggaatagcttttctgttatctctgttttgggttaagaaggggatagtaaaacaaagcggctggaagagtctgtcagcataccttaaggtttatgcagggatgtgcatatttgctggattttttctgattataccccttacaacactaacttattttttgcctggagagacatcgtcttatgttgcaccgtatcggtatacttccggtagttcaaaaagttgttctggagctgaggtggatgaccccgatctacatgagaatattcgcatttgctatccgtatggcaattatgagtacgataatattatctatgttgaaaagaaaattaatacattaggtgcggtagtaacatatgcacagaccgcgcgtgatgatactgaatgagatagtatatagcgggcaagttttagttaatttatcgaggtaatataatttacctcgactcgtttattctggtattaatatttcgctttacgatcgatttttatctgatgatatcatgcggttttcatatactgacttactgtcttttctccgttagcgattttctcctgctcagcgatgattttatctttggcttctagttaatttcgctcacttcgaacctctctgtttactgataagttccagatcctcctggcaacttgcacaagtccgacaaccctgaacggccaggcgtcttcgctcatctatgggatcgccacactcacaacaatgagtggcagatatagcctggtggttcaggcggcgcatttttattgctgtgttgcgctgtaattcttcaatttctgatgctgaatcaatgatgtctgccatcttccattaatccctgaattgttggttaatacgcttgagggtgaatgcgaataataaaaaaggagcctgtagctccctgatgattttgcttttcatgttcaccgttccttaaagacgccgtttaacatgccgattgccagacttaagtgagtcggtgtgaatcccatcagcgttaccgtttcgcggtgcttcttcagtacgctacggcaaatgtcatcgacgtttttatccggaaacggctgtctggcttttttgatttcagaattagcctgacgggcaatactgcgaagggcgttttcttgctgaggtgtcattgaacaagtcccatgtcggcaagcataagcacacagaatatgaagcccgctgccagaaaaatgcattcagtggttgtcataccaggtctctctcatctgcttctgctttcgccaccatcatttccagcttttgcgaaagggatgtggctaacgtatgaaattcttcgtctgtttctactggtattggcacaaacctgactccaatttgagcaaggctatgtgccatctcaatactcgttcttaactcaacaggagatgctttgtgcatatcgcctcccgtttattatttatctcctcagccagccgctgggctttcagcggatttcggataacagaaaggccgggaaatacccagcctcgcttcgtaacggagtagacgaaagtgatcgtgcctacgcggatattatcgtgaggatgcttcatcgccattgctccccaaatacaaaaccaatttcagccagtgcctcgtccattttttcgatgaactccggcaccatctcgtcaaaacccgccatgtacttttcatcccgctcaaccacgacataatgcaggccttcacgcttcatgcgcgggtcatagttggcaaagtaccaggcatcttttcgcgtcncccacatnctntactgnacctggnccanntaagccgactttatggcctngaaaccaccgagccggaacttcatgaaatcccgggaggtaaacgggcatttcagctcaaggccgttgccgtcactgcataaaccatcgggagagcaggcggtgcgcatactttcgtcgcgatagatgatcggggattcagtaacattcacgccggaagtgaattcaaacagggttctggcgtcgttctcgtactgttttccccaggccagcgccttagcattaacttccggagccacaccggtgcaaacctcagccagcagggtgtggaagtaggacattttcatgtcaggccacttctttcctgagcggggctttgctatcacgttgtgaacttctgaagcggtgatgacgccgagccgtaatttgtgccatgcatcatccccctgttcgacagctctcacgtcgatcccggtacgctgcaggataatgtccggtgtcatgctgccaccttctgctcagtggctttctgtttcaggaatccaagagctttcactgcttcggcctgtgtcagttctgacgatgcgcgaatgtcgcggcgaaatatctgggaacagagcggcaataagtcgtcatcccatgttttatccagggcgattagcagagtgttaatctcctgcatggtttcatcgttaaccggagtgatgtcgcgttccggctggcgttctgcagtgtatgcagtattttcgacaatgcgctcggcttcatccttgtcatagataccagcaaatccgaaggccagacgggcacactgaatcatagctttatgccgtaacatccgtttgggatgcgactgccacggccccgtgatttctctgccttcgcgggttttgaatggttcgcggcggcattcatccatccattcggtaacgcagatcggatgattacggtccttgcggtaaatccggcatgtacaggattcattgtcctgctcaaagtccatgccatcaaactgctggttttcattgatgatgcgggaccagccatcaacgcccaccaccggaacgatgccgttctgcttatcagggaaggcgtaaatttctttcgtccacggattaaggccgtactggttggcgacgatcaacaatgcgatgaactgcgcatcgctggcatgaaagcgcgatggggagacagggcggcatgagacgacagcgacgaagtttcaccgacatcatctgcgaaaactgcaaataccttccaacgaaacgctccagaaataaacgcaagccaatcccaaaagaatctgacgtaaaaaccttcaactacacggctcacctgtgggatatccggtggctaagacattgtgcgaggaaaacaaggtgattgaccaaaatcgaagttacgaacaagaaagcgtcgagcgggctttaacgtgcgctaactgcggtcagaagctgcatgtgctggaagttcacgtgtgtgagcactgctgcgcagagctgatgagcgattcgaatagctcgatgcacgaggaaaaagatgatggctaaaccagcgcgaagacgatgtaaaaacgatgaatgtcgggaatggtttcaccctgcattcgctaatcagtggtggtgctctccagagtgtggaaccaagatagcactcgaacgacgaagcaaagaacgcgaaaaagcggaaaaggcagaaaaggcagcagagaagaaacgacgacgagaggagcagaaacagaaagataaacttaagattcaaaaactcgccttaaagccccgcagttactggattaaacaagcccaacaagccgtacacgccttcatcagagaaagagaccgcgacttaccatgtatctcgtgcggaacgctcacgtctgctcagtgggatgccggacattaccggacaactgctgcggcacctcaactccgatttgatgaacgcaatattcacaagcaatgcgtggtgtgcaaccagcacaaaagcggaaatctcgttccgtatcgcgtcgaactgattagccgcatcgggcaggaagcagtagaggaaatcgaatcaaaccataaccgctatcgctggactgtcgaagagtgcagggccatcaaggcggagtatcaacagaaacttaaaaaactgcgaaacagcagaagtgaggttgcatgaatatctacgaaagaattgatggcagcaaataccgaaatatttgggtagttggcgatctgacggatgctacacgaacctgatgaaaaaactggagacgataggattcgacaccaaaaaagacctgcttatctcggtggcgatttggttgatcgcggacagagaacgtagaatgcctggaattaatcacattcccctggttcagagctgtacgtggaaaccatgagcaaatgatgattgatggcttatcagagcgtggaaacgtcaatcactggctgcttaatggcggtggctggttctttaatctcgattacgacaaagaaattctggctaaagctcttgcccataaagcagatgaacttccgttaatcatcgaactggtgagtaaaggaaaaaaatatgtcatctgccacgccgattatccttgtgataaatacgagtttggaaagccagttgatcatcagcaggtaatctggaaccgcgaacgaatcagcaactcacaagacgggatcgtgaaagaaatcaaaggcgcggacacgttcatctttggtcatacgccagcagtgaaaccactcaaatttgccaaccagatgtatatcgatactggcgcagtgttctgcggaaacctcacattgattcaggtacagggagaaggcgcatgagactcgaaagcgtagctaaatttcattcgccaaaaagcccgatgatgagcgactcactactggccacagtttattggttttcgtaactgagtcattttattattttattgcaacttttaatcttttatagtgcgaaataaatggagctggcattcatttcgcactttatgtttttgttggacttatgttattttgattgaattcaattcagttaaaaaaagaaggtgattgctccatttataaatgaatagtcatcccctgtcttgaattctgatgttactttattaaatgctagtgtgaaggctacaggtgcatacccaattgttgcgccaacttgatattcatcaacagttttgtttagcgatactgttgtttgtttcgtctgtattgtttttccttcgagagtatagttgcgattgacatctcgtctttccatacctgcaaaaatcttgtatttgaatccgcttgtatcggacatatgcattaaaccacggggagccagcagaccaaagccattatccgaattgaaggttttatcattaccaatggcaatggttgcgccatatgctacatattgaaataagtttccagtaacagcagaaacttcagggtataatccaacattagcacctaaaatatccatacttggtgtcatggatagcatcccttttacagtataaccgtagcgattctctatttgatcatcccatgcatgatatttttctgccccaataatctcatgagctttattttgtactttctgaccgcctgcgtcggggccaacaacacctatgtcagtacctaatcgatagcgaatccagtcattcgcaagggagttccattcaataccagtgtgagtgtatgcactaaaagctctgtctccagttacagctgtgttgtgtcttttattactgcctgatggagagtaaatatcttgcgcaatatggagagataattggctcgagtctgagatatcgtggctatatcccagaaataagccttgtgagtaatcatctctgttttcatgtttattgccataaatatcattaagtattggttgaaacttccctgcatcatcatttgctaatgataatgcaaggctgttcgcgatagctgaacacgtggtaaatgacagagcaataaagacgccagcgatgacactttttttcatatgttattgtcttccttttttttgaatggtgcgcgtattttacatacatgagtttgtaatgcaaggtgcgtaatcaatatgatgttttataattgcgtgagacaattgatttattcgttttttattgcggtttttattatcttttaatgtaacggtgtttttattaagtgtgtttgcgtggtgttttatgttttttataattttattttattaaatttaaatgcattagtaatggctattctatatagcaatataagaactgttacaaaaaaagggggggcaattacaggtagttatggatgatgagtgaaacagatattggagaaccggggaatgaatgatgtctgagtcttatatatcagaactccttcgctgtcgctgggggctcctgtgcttatgtcgtttccccgattcggttttgaacgattaccgaatgttgaagaattatgccaaaatatagaaaggatttactgcatgaatacccaatatttacagtatgttcgtgagcaacttatggcagctactgctgacttgaacggagcaacgaaaggccagctcgaagcctggcaggagcatgcacaatttgatactggtacatacaaacgaaagaagccgcgcattctggatgtggtaactggcaagatgattacgctggataatacgccgacttccggtaagcagtcgtacgcaaaaggttcatccattgctttggtcagcccggttgaattctcaacctcttcatggcgccgcgcggttttgtctctcgatgaacatcagaaagcatggttgctttggtgttacagcgaaagcgttcgatgggggcatcaggtcaccataacgcaatgggcatggagcgagtttaaagatttgttaagtaacagaaaaattgcaggtaagacactggatcgcctgaagacgttaatctggctggctgcacaggatgtgaagagcgaacttgcagggcgtgaggcctatgaataccagacactggcatcattggtgggagtgacaacaaaaaactggtccgagacatttactgaacgctgggttgcaatgaagcacatttttctacagcttgatagtgatgctttattgcttgtgacgagaacacgttcaaaacaaaaggcagcatttttacagcaaaatattgcaaaactggattaaaagccatatacttcatgcaaatttggtatgttgtaaaaatgttataaacccgctgccgagtgggtttttttatgccctgagttgtacttgtacgntaaacatgatgactgctatgtaatagagtttttttagcctgtaacctcttgacggcattgaattgcttttgttatgagttgtaagccaatgttatcatcttgtattggggtggttatgaaggatggtgcgctgctcaggagttcttcactttttattgcctacntgggatgccttggatgggggagtgcttatttctatggatggggtacttctttttactacggcttcccatggtggattgtaggtgcaggtgttgatgatgttgccagaagtttattttttgcagatatcgtcattgctatatttcttatcggttggggtattggtgttgtattctttttcgcagtgaaaagaaaacattctatgcaagagctaaatgtatttcgcctttattttgctgtggaattattgtttgtgccggcaattattgagttttctatattgagacagaagattcaggtacctcttttgctactgtcagcagcgattgcgctggcggttacaatttcgataagatcttatgggcgatttttatcggtatcatgcttctatgataagccatttataaaaaaacatttttttgagattgtgatgattgcttttgtggcatatttctggcttttttcatttctgacaggatattacaaaccacagtttaagaaagaatatgaaatgattaattataatgatggttggtattatgttcttgctcgttatgataattgtctggttttgtctacttctttcaatgcaggtagtaaaaggtttgtcatttatcaatcagcacaagataagaatcttcaggttgatattgtaaggaccagaatttaattggctgcataaataatattttaagttgcaagttggctattcgtaggaatagaaccttaggcatgctgaatgcgtttcctgaacattgttttataaactgtgtctgcttgctgttgtgatcctgcttttagtgatggtgatgatggatttcaccagcaggataatgttggtactgactgatggcgctctggtctgcggcattgtggtattgctgtggccgatgatgaaagaacagaatgaataattcttgacttttttgtttactgtttattaaaaaatcaaccgcatggtgaatcctccttggaggggctaaatgatcgagttttaagggcacgtagcgagttctgtttgatcattgcagaacttagcgggaggcgccatgcgtacatcactaatgttatttccttctatcattttccttgtgagttctggctgcgcatggcgcggccttttttttatgacctgccactggcagatggtcatcctgtgatttgattccggttccggctttttaactctgttcctgtacacgggagaaattctatgtcgattaatcgttatgatattggttacaagaagtaccacgtattgtgttgagatagaaagcatggtgccagaggtaaatgcagcagcataataaaaaagagccagcgcagaagagaacgggtaaaagagtctgcgctggcgtggggatattccccgtggagaaatgatatgtaacacacatcgggaacctttctatataaacattatcattattgtcaatcataacagtcaggtattatgacgtttatgcatcagggccatcaggaattaactggtggctttttattgttgtcagcttccggataacgggagacggggtatgtaccagatggaaaaaataacaacaggtgtgtcatacaccacgtcagcggtggggacgggatactggctactgcagttgctggacaaagtctccccatcccagtgggtggcaataggcgtattgggtagcttggtgtttggcttgctgacgtatctgacaaacctttatttcaagattaaagaagataagcgtaaggctgcgagaggtgaataatgtcgccatcattacgcaaggctgttgctgctgctattggtggtggggctgctgccatagcgtctgtgctcatcactggtccgagtggtgacgatggcctggaaggtgtcagctacataccatacgaagatatcgttggcgtatggactgtatgtcacggacacaccggaaaagacatcattcccggtaaaacgtataccgaagcagaatgcaaagccctcctgaataaagaccttgccacggtcgccagacaaattaacccgtacatcaaagtcgatataccggaaacaacgcgcggcgctctttactcgttcgtttacaacgtgggcgctggtaatttcagaacatcgacgcttcttcgcaaaataaaccagggtgatatcaaaggcgcatgtgatcagctacggcgctggacatacgctggcggtaagcaatggaaagggctgatgactcgccgcgagattgagcgtgaagtctgtttgtgggggcaacaatgagcagagtaaccgcgattatctccgctctggttatctgcatcatcgtctgccagtcatgggcggttaatcattaccgtgataacgccatcgcctataaagaacagcgtgataaaaaagtcagtgagctgaagcaggcgaccgccaccattactgacatgcagcagcgccagcgtgctgctgatgcactcgatgctaaatacacgaaggagttagctgatgcgaaagctaaaaatgatgctcttcggcgcaagcttgataatggtggtcgggtgttcgtcaaaggaaaatgccctgtgccatcctcagacgaaacctccagcgcctccggcatgggcaatgatgccaccgtcgaactctctccagttgctggacgaaacgttctcggtatccgggacggaattatccgcgaccaaacagcactgagaacgcttcaggaatacatcaggacgcaatgccttcgatgatagcgataattttactcatcatccttcacatctggctctgtagacagggtggtgctcacttctggagtgaatcatggttaaacatctcattgctgatgcttgatattgagcatctggcgcgcggtaaggggctgcgttgagataagagccagtcattaaaaatacctggatttagcctcgcattcgcggggcttttttattgccattacaaaagccactccctacagagtggctttgataatggcttataccctacacgggataacttaactgatatcccttttaacggataaaggtattcaagcctgacacatcatgcgctgtatcgtcgctgtattcccgcattaaccatgaccgtagcccgacggggaactccttctgcgcgagtgtgcgggaataatcaaaaacgatgcacaccgggtttttaccgcgctaatgattcgcgggtttgtccctcatgctcgccagtcctgtgcgggggtggaagaaacaggacactcacacagattcttgtgggtcgatgctattcctttctggattatcccgatgccattcatgcaagggctgtatcagacgttcgtcatggctttcaggctgacggctcctcccggtggggtggcctgccacggggcgggagcgtcgcggaaaaaggctagtttttgcatttttatcggccaccatcatctttgcatcttattgattattaatggttatttgttttttgtatgtcgaattgagtgttttttgttcgacatcgaacgcgttttcttaaagttgttcgcacgatgcatgtttaaagctctccggaggaaatatggatcatgagttgaaaaacctggtgctgaatattaatcaactggcggctttatctggtctgcaccgccagactgtcgtggcaagactgaaaaacattcgtcccgctggtggacatgacaaactcaagctataccggttgaccgatattctgactgaatttatggggttaccaccgccggttgctgagggcgaaatggatccacatgaacgcaaagcctggtatcagtctgaacgtgagcgtcttaagttcgaacaggaaacggcacaactcattccggccagtgatgtcagacgggagtttgccatctgggcaaaagcggtcgtgcaggtgctggagacattaccggatattctggaacgtgactgtggtctgcagcctgccgctgtgagccgtgttcagtccattattgatgatctgcgcgatcagatagccctgcgggtgaccgaagcaggtgcggatgatgaggaggaattacagcaggaggagtaatgctgaatcaggaaaccgcaaaggcagcacgaaccgattcaggttatatccttcgcgcaccgagacgaatgcgggttgctgatgccgttgctcagtatatgcgggtgcccatgggggccgggaactcagtcccgtgggatccgctggtggcaccgtatgttattgagccgatgaactgcctggcctcgcgtgaatacgacgcagtgatatttgttggcccggcacgaaccggcaagactatcggcctgattgacggctgggtgatttacaacgtgatttgcgatcctgcggatatgctgatcattcagatgacggaggaaaaagcccgcgaacactccaaaaaacgactcgccagaacgtttcgcgtcagcccggaagtggtcagtcgcctgagtccgaacaaaaatgacaacaacgtttatgacagaacattccttgctggcaactacctgaaaatcggctggccgtcagtcaatatcatgtcctcatcagattataaatgcgtggcgctgacggattatgaccgttttccggaagatattgatggcgagggggatgccttctctcttgcctcaaaacgtaccaccacatttatgtccagtggtatgacgctggtggagagttcccccggcagggatgtgaaggatgtgaaatggcgacggacttcaccgcatgaggctccaccaaccacggggatactgtcgntctataaccgtggcgatcgccgtcgctggtactggccctgtccacactgtggtgagtattttcagccctgcggcgatgtggttgctggtttccgtgatattgccgatcccgtgntggcaagtgaggcggcttatattcagtgtccttcctgttcaggacggattatgcctgaacaaaaacgtgagctgaacggacgtggggtctggttgcgggatggtgaatccatcaatgcggatggtagtcgttatggtgatccccgacgctcacgtattgcgtcattctggatggagggtccggcagctgcttaccagacactctcgcaactcgtttacaaactgcttactgcagaacaggaatacgagacaaccggaagtgaagaaacactcaagacggttatcaataccgactggggattaccttatcttccccgcgccagcatggagcaacgaaaaagtgaactgcttgagcagcgggcagagccagttccttccagcagtgtgccggatggcgttaatttccttgtggcgacagtggatgtgcaggcgggacgtcatcgccgttttgtggttcaggtaacgggctatggcagccgtggcgaacgctggattattgatcgttacaacatcacgcagtcattgcgcggtgacagcgacggtgagagccagcgaattgatccggccagttatccggaagactgggatgtcctgctgacggatgtttttcataaaagctggccgctggcctccgatccttctcaacaaatgcgactgatggcaatggcggtggactccggcggtgaagacggggtcactgataatgcctataaattctggcgtcgttgccgtcgtgatggccttggtaaacgtatttacctgtttaagggcgacagcatccggcgcgcaaaactgatcacccgtacattccctgataacaccggacgaacgggccgacgggcgcaggccgcaggtgatgtgccgctctggcttcttcagacggatgcactgaaagaccgggtgaataacgcgttatggcgtgactctccaggtcccggctatgtgcatttccctgactggctggggagctggttttacgacgaactgacgtatgaagagcggagtagtgacgggaaatggagtaagccgggtcgcggtgccaacgaagcttttgacctgatggtgtatgccgaggctctggtcattctgcatggatacgaaaagatccgctggccggatgcaccggggtgggcgagccgggaaacctggctggagagtgtcccggacagtaccgaaccgtcaccctcaccggaaccggtatccacgcctgttaaaaaacaaaaacggaagaaaacagtaactgacgatgttaacccctggctgacttccggaggatggttatgaaccagaatgatatcgaagccatgattcagcgttatacggaagctgaaatggcggtgctggacggaaaatccgtcacctttaatggtcagcagatgaccatggaaaacttatctgagatccggcagggacggcaggagtgggagcgccgccttgcggctctgattacacgacgacgggggcatcccgggtaccggctggcgaggttctgatggcaattcttgatgatgtgattggcgttttttcaccaggatggaaagcggcaaggctgcgttcccgtgcggtgatccaggcttatgaggccgtaaaaacgacgcggacacacaaagcccggcgggaaaaccgaactgccgaccagttaagccagtacggggccgtgtcgttacgtgagcaggcccgttaccttgataacaaccacgatctggttattggtgtatttgacaagctggaagaacgggtggtggggaaaaacgggattattgtcgagccacatccggtattacgcaatggggccattgcccgtgatctggcagcggagatacgcacccgatggagtgaatggtctgtcagtccggaagtcaccgggcagtttacccgtccgatgctggaacgtctgatgctgcgtacctggctgcgcgatggtgaggtgtttgcccagatggtttccgggcgcataaacagcctgacgcttctgccggtgttcatttctggctggaggcgctcgagccagactttattcccatgaccagtgatgagagcaacaggctgaatcagggcgtgtttgttgatgactgggggcgtcccgaaaaatatctggtgtataaaagccgtcccgtatccggacggcagatggaaaccaaagaagtggatgcagagcgaatgctgcatcttaaatttgttcgccgtctgcaccagatgcgcgggacgtctttgttgtccggtgtgctgatccgcctcagtgccctgaaagagtatgaggattctgagctgactgcagcaaggatcgccgctgctctggggatgtacatccggaaaggcgatgggcagagctatgaaccggatggtaatggcagcaaggataaggaacgcgagcttaccattcagccaggcattatttacgacgatctgaaacccggcgaagaaatcggaatggtgaagtcggatcgccccaatcctaaccttgaaacttttcgtaatggtcagttgcgtgccgtggcggcgggcagtcgtctgaattttttccagtacagcgcgcaactataacggcacttacagcgcccagcgtcaggagctggttgaatccactgatggctacctgatcctgcaggactggtttattggtgccgtcacccgcccgatgtatcgtgcctggctgaaacaggctgtggcatccggtgttatcaggctaccccgcgatcttgaccgttcttcactgtataccgcggtgtattccggaccggtgatgccgtggattgaccctgttaaggaggctgaggcctggaaaattcagattcgtggtggagcagcgacagaatcagactgggtacgtgcaggtggtcgtaatccggatgatgtcaaacgtcggcgcaaggccgaaattgatgaaaaccgcaagctggatctggtatttgataccgatccggccagtgataaaggaggcagcagtgccgcaacgaaacgacaggagccgcagcacaccgacgaccagtccgaagaataattcctggttcaggatgcaggctggtcaccagagtgacgcggatatttatatttatgacgagattggtttctggggtgttacagcgaagcagtttatcagtgatctgaatgcactgggcgatatcacccacattaatctcaatatcaattcaccgggtggcgatgtctttgaaggcatcgccatttttaatgcactgaaaacacatggtgcgtccattaccgtttatgtcgacggtgtggcggcgtcaatggcgtcggtcattgcgatggtgggaaaaccggtcattatgccggaaaactccttcatgatgattcataaaccatttggctttacgggcggtgatgcggaggacatgcgcacctatgccgacctgctcgataaagttgaggcggttctgttacccgcttatgcacagaaaaccgggaaaaccaccgatgaaattgctgccatgctggcggatgagacctggatgtccggtgccgaatgtctggcacatggatttgctgatcaggtgacgccagccgttaaggcaatggcatgtattcagtcaaaacgtacagaggaatttaaaaagatgccggaatccattcgaaacatgattactccgccacgcaacagtgctccacgcgtacaggatgatggacctgcagcctcccggacgccagtgcaggcagcagcacctgtggtggatgaaaacagtatccgtgcgcaggtactggcagagcaaaaagcgcgtgtaaacggtattaatgatctgtttgccatgtttggcgggcgttatcagacgctgcaggctcagtgtcttgccgatcctgaatgttcgctggagcaggcccgcgaaaagctgttgaacgagatggggcgcgagtccacgccatctaataaaaataccccggctcatatttatgccggaaacggtaattttgtgggggatgggatccgccaggcgctgatggcgcgtgccggatttgaaaaaaccgaacgtgataatgtctacaacgggatgaccctgcgtgaatatgcccgtatgtcactgactgaacggggtattggggtttccagttataacccgatgcagatggtcggtgcggcgttcacacacagtacgtctgacttcggtaatattctgctggatgttgcgaacaaagccattctgcagggctgggaagatgcccctgaaacctatgaacagtggacgcggaaaggtcagttgtctgattttaaaattgcccatcgtgtgggtatggggggcttcagtgctctgcgtcaggtgcgtgaaggggcggaatataaatacgtcaccaccggagataaacaggccactattgcactggcgacctatggcgagctgttcagtatcacccgtcaggccattatcaatgatgatctgaatatgctgaccgatgtcccgatgaaactgggccgtgcggcgaaatccactattgccgatctggtttatgccattctgacgtctaacccgaaaatctccacagataatgtaagtctgttcgataaagcgaaacatgcaaacgtactggagagcgctgcaatggacgtggcatcgctggataaagcccgccagttgatgcgcgttcagaaagagggggagcgtcatctgaatattcgtcctgcgttcgtactggtaccgacggcgatggagtctgttgctaaccaggtcattcgctcctcaagtgtcaagggggctgacattaacgccggtattattaacccggtgaaagattttgcgaccgttattgcagagcctcgtcttgatgataacagccagaccaccttctacctggctgcgtcaaaaggctccgatacgattgaagtggcttatctcaacggtgtggatacgccatatattgatcagatggagggcttcagtgtggatggcgtgacaacgaaagtgcgtattgacgccggtgtcgcgccagttgatcaccgcggtctggtgaaatgtacggcgtaaacgtcgcagacaacaactctgatggcccgtaagggctttttttgtacctgaaatcagcccctgaacggggctgtgcggagacagttatggcaaagaattttgtagaagaaggaaaaacggtggcgattgttgccagtgcagccatcagcagcggagatctggtgcaggtgggcgatgtttttgcggtggcgctgaccgatattccacagggtgaaacaggcgacggcatgaccgaaggtgtgtttatgctgcctaagctgaaaacggatgacatgaaaacgggtaagaaggtttatctgaagtcaggaaaagttcagctgactaacagcggctctgatccgctggtcggggttgtctgggcagatgccggaaccagtgcagaagaagtgccggtaaaactcaatgtctgatcccttttcccggctggcagcgcgtatggatgctatcacggtcagaaagatgggaaagacagcctcgattaatgatgtcgatatgactgtgatcccgggagaaacactggcagagctgaatgctctgtccggacctgcggtctctctggtggtgttttcttcgggataccgcccacggcgcggggatcgcgttgtttatgacggacaacaatggacggtcacacggcatgaacgctttaacggtaagccaatgatctttattgagtaaagaggtgtgggatgaaggggcttgagaatgccatccgcaatctgaacagccttgatacccgtatggtgccacaggccagcgcatgggcgataaaccgtgtggcacagaaagcgggctcggttgccacccggcaggttgccgggaataccgttgcgggagataaccaggtgaaagggatccccctgaaactggttcgtcagcgtgtccgggtgtttaaagccagtccgtcaggaaaaatgacggccaggatccgcgttaaccggggcaatctgcccgccattaagctggggacagcccgggtcagactggcccagcgtggtggaaaactgcagtaccgtggcagtgtgctgaaggtgggtaaatatcttttccgggatgcgtttattcagcaactggcgaatggtcgctggcatgtgatgcggcgtattgatggcaaaaatcgttaccccattgatgtggtgaaaatcccgctgtccggaccgctgacacaggcatttgaagatgcccgcgaccgcatcattgctgcggaaatgccgaaacagctggggtatgcactgaaacaacaactgaggttatggctgacccgatgaaccgacatacacaaatccgccaggtcgtactggcacgccttcgggaacagtgtggagacagcgccacgttttttgacgggcttccggcatttgttgatgcgcaggaactgcctgccgtggcggtgtggctgagtgatgctcagtacaccggaaaaatgacggatgaagatgactggcaggctgttctgcatattgctgtcttcatccgggcacaggcaccggattcagagctggatatgtggatggagagcaccattttcccggccctgaatgatgtatcggcactttccggactcatcgacaccctgatcccactcggttttaactatcaacgtgataatgagatggccacctgggcgatggcggaaatcacgtaccagatcacgtacacgaattaaggaggtggtaatgaccacgccaaatccactggcaaagacgaaaggtgcggggacgacgttctggatgtataccggcaacggcgatgcgtttgcgaaccctttgtcggacactgactggctgcgtcttgcgatggtgaaggatctgcaacctggcgaaatgaccgctgatgcagaagatgacacttatctcgatgatgaagatgcagactggaaaacgacaacccaggggcagaaatccgttggtgatacttcggcgacgctggcctggcgtccgggtgacagcgggcagaaaaaactggttcagttgttcgactccggtgaagtctgcgcgtttcgtatcaaatatcccaacggcactgttgatgttttccgcggctggctgagctcactgggtaaaaccattgcctcaaaagacgtgatgacccgcacagtgaaaatcagcggtgtggggcgtccatatctggcagaggagggcactgaaactgtgggcgttaccgggctgacggtggcaccggcatccgccagtgtcaatgtgggagcaaccaccacgctgacctttacagtaaaacctgacggagccagtgacaaagcgatcagtgtgcattcgacagatccacagacagccactgtgaccctgaacggacttgtggccacggtgaaaggcgtgaagcagggcagcgtcagcattgtgggcatgaccgctgacgggaattttgtggctgtggctgcggtgactgtcagcgctgcaggttaacaggacgatactcatcatttgccccggttatccggggcttttttgcaggtggagaacatgatgtttctgaaacagggcacgtttaattatgaaaagcagtccgtggtgctcagtgagctgtccgggctgcagagaattgaatatctggcgtttgttcagcagcgaacggcaaagtttgatgccgaagagggagaactgccggaggctgaacgacagattgcttttctgcggatggggatggatatcaatgcttggctggtttcccgctcactgtggaatgcggaacagtctcaggatgttgagacgctttgcgcatccgttattacaacatggtcgtatgatgccctgggagcgggggcggagatggttctgtcgctgagcggtatgggagccattgagaatgccggggatttggagcatgaggtgctgacgccggaaaagtcctgacgcgggaaatgcagtttgtcatgcggcttgcccgggagttccggcgggcagactggcggcggatgctgtcggaaatgtcggccactgagcttggtgagtggggcgattatttccggatgcagagcttcagtgatgtgtggatggatgcgcagtttgcctcgctgaaggcattgatcgtgagaatggtgtccggtagcagtgatgctgcggtggctgatttcagccttttaccggaagagaacgggataccggagcgaacggacgaagaactgatgcatcttggggaaggtatttccggaggtgtgcgttatggaccagatagccaacctggtcattgatttggggattgatgcggcagagtttaaaaatgaaattccccgtatcaaaaaccttctgaatggtgcagccagcgatgcagaacggtcttctgcccgtatgcagcgttttatggagcgtcagactcaggccgcccggcagacaatgcaggcggcttcttcggctgcaacagccgcatccgtccatgcgcagacggtggagaagagcgcacaggctcatgaacgcatggcccgcgaggtggagcaaacccgccagcgtatggaggcactgagccagaaaatgcgcgaggaacaggcgcaggccatggctctggcggaggctcaggataaagcggctgctgcgttttatcgtcagattgacagtgtgaaacaggccggtgcggggctgcaggaattacagcgtattcagcaacagatccgacaggccagaaacagtggcgggattggtcagcaggattatctggcgctgatttctgaggttacggcgaaaacccgtgttcttacacaggctgaggaagaggctacccgacagaaagtggcgtttatccgtcagcttaaagagcaggcaacccgccagaatctttcttcttctgagttgcttcgtgctaaggctgcccagctgggggtaagcagtgctgcagaagtgtatatccgcaaaatggagcaggcaggaaaagccacgcattcgctgggtctgaaaagtgcagcagcccgtcaggagataggcgttctgataggtgaactggcccgcggcaatttaggtgcgctgaggggatccggaataacgctggctaaccgtgccgggtggatagacacactgatgtcaccgaaaggcatgatgccaggagcggttattggcggtattgccgcggctgtctatggtctgggtaaagcctggtatgacggtcagaaggagggggaagaatttaaccgccagctgtcgctgacggggcattatgccggagtcactgccgggcagctgtggacgctcagtcgtgctatttccgggaatggtatcacgcaacatgctgcagccggtgcgctggctcaggtggtggggagtggtgcatttcgtggaaacgatatcggtatggtggcgagagctgccgcacagatggagcgatcggttggccagtcggtcagcgataccataaatcagtttaagcggctgaaggatgatcctgtaaatgccgcgaaggctctggacaatgagctgcattttcttactgccactcagcttgagcagatacgcgtccttggggagcaggggcggtccagtgatgctgcacggatagccatgtctgcactggcagaggaaaccggtcggcgtactgcggatattgataataacctcaatgcgcttggcagtacgctgaagtatctgtctgatttgtggagtcgtttctgggatgcggccatgaatattggtcgtgaagactcgctggatgaacagattgccgctttacaggagaaagtgtcgcgggcgaaaagactcccctggacggcatcatcttctcaggttgaatacgatcagcagcgtcttaacgatcttcaggagaaaaaacgccagaaggatttgcaggatgcaaaagagcaggcagagcggaattatcaggagcaacagaaacgccgtaatgctgaaaatgctgcactgaaccggatgaatgaaacggaagcagcacgacatcagcgtgaaatagcgcgtattaatgccatgcagtacgccgatcaggctgtcagggatgcggcgatacaacgtgaaaatgaacgttacgagaaagccctggcatccggtaagaaaaaaacacgcgaaacccgtaatgatgaggccacccggttattgctgcagtacagtcagcaacaggcacaggtggaaggacagattgctgctgccagacagtcagcaggcattgccacggaaaggatgacagaagcgcgtaaacagcttctggctctgcagcagcgcatcagcgacctggacgggaaaaaactgacggcagatgaaaagagtgtgctggcccgtaaagatgaactgattcaggcactgacgctgctggatgtaaaacagcaggagcttcagaaacagacggcactcaacgagctgaagaaaaaaacaattcagctgaccagtcaactggctgaagaagagcgcgctcagcgtcagcaacatgacctggatatcgccacggtgggtatgggtgatcagcagcgacagcgatatcaggtacaactgagtcttcgccagaaataccagcaacagctggagcagttgaggcgggatagtgagcagaaagggacatataacacggatgactacagaaaggccgagcaggcgctgacggagagcctgaaccgacaactgaatgagaatcgccgttactggcaacagcttgaagttgtacagggtaactggaaaaacggagtcctgcgtgcatttcaggattttaccgtggatgcagataatacggcagaaacagcagaacaggtgttctcgtcagccttcagcaacatgggaaatggcctggcaacttttgtcactaccggcaaactcaatttcaaatccttcacctcttctgtgctgtcagatatggcgaaaatcctggcgcaggcaaccatgatgaaatcgataaaagggattggcagtgtactgggatttgatctcagcagcctttccctgaatgccaatggggggatttatcagtctgctgatttgagtcgttacagtggcacggtggttaaccgtccgacgttttttgcttttgcaaaaggcgcgggtgtgatgggggaagcgggacctgaagccattctgccattgcgtcgtggtgctgacggtaagctgggggttgtggcggatattgggggttcaggtatggcgatgttttccccgcagtacaacatcgagatcaataacgatggcacgaacgggcagataggtccggctgccctgaaggcggtttatgacctcgggaaaaaagcggcagcggactttatgcaacagcaggcccgtgatggtggtcggttaagtggagcatatcggtaatggagacgtttcactggaaagtgcgcccggatatgaatgtggtatcagagccgaaagtggtgacagtgaagctgggcgatggttatgaacagcgtcgtgcggcgggactgaataaccagttgtcgacttacagcgtgacgatacgtgttcgtaaatgtgaacacccatctttaaaagcctttctggaacggcacggtggcgtccgtgcatttcagtggacgccaccttatgactggaaaccgatcagggtggtttgtcgtaaatggtcggcaagcgtgggggcgctgtgggtaaccataacggcagattttgaacaggtcgtggcataggaggctctgatgcaggatattccacaggaaacacatcatgagacgacacgcctcactcagtcagcccaggcggtgctctgggaaatcgatctgacagaggtcggtggtgaacgttattttttctgtaatgagcagaacgaaaaaggtgagccggttacctggcaggggcggcagtatcaggcataccccattcaggggacgggatttgaactgaacggcaagggcagttctgcccgtccgacactgacggtttctaacctgcacggcatggtcacggggatggcggaagacctgcagagtctggtcggcggaacggtggtccggcgtaaggtttacgcccgttttctggatgcggtgaacttcgtcaacggaaacagcgacgccgatccggagcaggaggtgatcagccgctggcgcattgagcagtgcagcgaactgagcgcggtgagtgcctcttttgtactgtccacgccgacggaaacggacggcgctgtttttccgggacgtatcatgctggccaacacctgcacctggacctatcgcggcgatgagtgcggttatcacggtccggcggtcgcggatgaatatgaccagccaacgtccgatatcacgaaggataaatgcagcaaatgcctgagcggttgtaagttccgcaataacgtcggcaactttggcggcttcctttccattaacaaactttcgcagtaaatcccatgacacagacagaatcagcgattctggcgcacgcccggcgatgtgcgccagcggagtcgtgcggcttcgtggtaagcacgccggagggggaaagatatttcccctgcgtgaatatctccggtgagccggaggcgtatttccgtatgtcgccggaagactggctgcaggcagaaatgcagggtgagattgtggcgctggtccacagccaccccggtggtctgccctggctgagtgaggccgaccggcggctgcaggtgcagagtgatttgccgtggtggctggtctgccgggggacgattcataagttccgctgtgtgccgcatctcaccgggcggcgctttgagcacggggtgacggactgttacacgctgttccgggatgcttatcatctggcggggattgagatgccggattttcatcgcgaggatgactggtggcgtcacggtcagaatctctatctggataatctggaggccacagggctgtatcaggtgccgttgtcatcagcacaaccgggcgatgtgctgctgtgctgttttggttcatcggtgccgaatcatgccgccatttactgtggtgatggcgagctgctgcaccatattcctgaacaactgagcaaacgagagaggtataccgacaaatggcagcgacgcacacactccctctggcgtcaccgggcatggcgcgcatctgcctttacggggatttgcaacgatttggccgccgcatcgaccttcgtgtaaaaacgggggccgaagccatccgggcgctggccatgcagatcccggcgtttcgtcagaagctgagcgacggctggtatctggtacggattgccgggcgtgatacaggtgaaaatgaattatctgcccgtcttaatgagccgctggcaaatggtgccgtgatccacatcgtgccgcgcctggcgggtgctaaaagtggcggtgtgtttcaggcagtgctgggtgcggcgctgattgcggtggcatggtggaaccctgtgggctggctgggggccgcggctgtatcgggtatgtatgcagcaggggccagtatgatcctgggtggtgtggcgcagatgctggcaccgaaagccagaactccccgtacacagacaacggataacggcaaacaaaacacctatttctcctcactggataacatggttgcccagggcaatgttctgcccgttctgtacggtgaaatgcgcgtgggatcacgtgtggtttctcaggagatcagcacggcagacgaaggggacggtggtcaggttgtggtgattggtcgctgatgcaaaatgttttatgtgaaaccgcctccgggcggttttgtcgtttatggagcatgacgaatgggtaaaggaagcagtaaggggcataccccgcgcgaagcgaaggacaacctgaagtccacgcagctgctgagtgtgatcgatgccatcagcgaaggaccgattgaaggtccggtggatggattaaaaagcgtgctgctgaacagtacgccggtgctggacagtgaaggtaataccaacatctccggtgtcacggtggtgttccgggccggtgagcaggagcagacaccgccggagggatttgaatcctccggttctgagacggtgctgggtacggaagtgaaatacgacacgccgatcacccgcaccatcacgtcggcaaacatcgatcgtctgcgctttactttcggtgtgcaggcactgcgggaaaccacctcaaagggggaccggaatccgtcggaagtccgcctgctggttcagatacagcgtaatggtggctgggtgacggaaaaagacatcaccattaagggcaaaaccacgtcgcagtatctggcctcggtggtggtggataacctgccgccgcgcccgtttaatatccggatgcgcaggatgacgccggacagcaccacagaccaagctgcagaacaaaacgctctggtcgtcatacaccgaaaatcatccaatgttgaaacagtgctacccgaacacggcactggttggcgtgcaggtggactcggagcagtttggcagtcagcaggtgagccgtaattatcatcttcgcgggcgcattctgcaggtgccgtcaaactatgatccggaaaaacgcacttacagcggcatctgggacggaacgttaaaaccggcatacagcaacaacatggcctggtgtctgtgggatatgctgacccacccgcgctacggcatggggaaacgtcttggtgcggcggatgtggataaatgggcgctgtatgtcatcggccagtactgcgaccagtcagtaccggacggctttggcggcacggagccgcgcatcacctgtaatgcgtacctgaccacgcagcgcaaggcgtgggatgtgctcagtgatttctgctcggcgatgcgctgtatgccggtatggaacgggcagacgctgacgttcgtgcaggaccggccgtcggataaggtgtggacctataaccgcagtaatgtggtgatgccggatgatggcgcgccgttccgctacagctttagcgccctgaaagaccgccataatgccgttgaggtgaactggactgacccggacaacggctgggagacggcgacagagcttgtggaggacacgcaggccattgcccgttacggtcgtaacgtcacgaagatggatgcctttggctgtaccagtcgggggcaggcacaccgtgccgggctgtggctgattaaaacggaactgctggaaacgcagaccgtggacttcagcgtgggcgcagaagggcttcgccatgtaccgggcgatgtcattgaaatctgngangccgantntgcggggatcagcatcggtgggagtgtgctngcggtgaacagccagacccggacgntgacgttcgacngtgaaatcacgntgccatcntccggcaccacgctgataagcctggttgacggaagtggcaatccggtcagcgtggaggttcagtccgtcaccgacggngtgaaggtaaaagtgagccgggttcctgacggtgttgctgaatacagcgtgtgggggctgaagctgccgacgctgcgccagcgcctgttccgctgcgtgagtatccgtgagaacgacgacggcacgtatgccatcactgccgtgcagcatgtgccggagaaagagggcatcgtggataacggggcgcactttgacggtgaccagagcagcacggtgaatggtgtcacgccgccagcggtgcagcacctgaccgccgaagtctccgcagacagcggggaatatcaggtgctggcgcgatgggacacgccgaaggtggtgaagggtgtgagcttcctgcttcgcctgaccgtggcagcggatgacggcagtgagcggctggtcagcacggcccggacgacggaaaccacataccgcttcacgcagctggcgctggggaactacaggctgacagtccgggcggtaaatgcgtggggacagcagggcgatccggcgtcggtatcgttccggattgccgcaccggcagcgccgtcacagattgagctgacaccgggctattttcagataaccgccacgccgcatcttgcggtttatgatccgacggtacagtttgagttctggttctcggaaacgcggattgcggatatcaggcaggttgaaaccagcgcgcgttatcttggtacggcgctgtactggatagccgccagtatcaatatcaaaccgggccatgattattacttttatatccgcagtgtgaacaccgttggcaaatcggcattcgtggaggccgtcggtcgggcgagcgatgatgcggaaggttatctggattttttcaaaggcaagataaccgaatctcatctcggcaaggagctgctggaaaaagtcgatctgacggaggataacgccagcagactggatgagttttcgaaagagtggaaggacgctaacgataaatggaatgccatgtggggcgtcaaaattgagcagaccaaagacggcaaacattatgtcgcgggtattggcctcagcatggaggacacggaggaaggcaagctgagccagtttctggttgccgccaatcgtatcgcgtttattgacccggcaaacgggaatgaaacgccgatgtttgtggcgcagggcaaccagatattcatgaacgacgtgttcctgaagcgcctgacggcccccaccattaccagcggtggaaatccaccggtattttccctgacatcagacggaaagctgaccgctaaaaatgcggatatcagtggcagtgtgaatgcgaactccgggacgctcaacaacgtcacggtaaatgaaaactgtacgattaagggcatgctggaggcgactcaggtcagaggtgacttcgttaaagctgtatccaaatcatttccgaaacaggctggtacgtggggtaacacggaaacaccaaacgggacggttacagtcaccatcagcgatgatcataactttgaccgtcaaatcattattccgcccattatctttaacggaatagcgtatagcgatccgggaagtggtaataacccgggaggtacaagatacacgggttatggttttgaagttcgcaaaaacggtgtattaatcgcatccagagaaactaaaggggccattcccggtagctacagtgcggttattgatatgccgagtggcaggggaagcgtcactctggagtttaaggttttccataaaggcaatcagcgggcaggtaatatcaccgactgtacggtgattgtgaccaaaaaagcggcttccggcatcagtatccgttgaaatatttataaccctaataacgggcgccagaaatggcgccttttttattgcagaaaatcgggaggtaattatgcgtaaagtttgtgcagcaattttgtccgcagccatttgtctggccgtatccggtgtgcctgcatgggcgtctgagcatcagtccacgctgagcgcaggatatcttcatgccagtacggacgctcccggcagcgatgatctgaacgggattaacgtgaaataccgttatgagtttacggacacactggggctgattacgtccttcagttatgccaacgccgaagatgagcaaaaaacgcattacagcgatacccgctggcatgaggattacgtgcgtaaccgctggttcagcgtgatggcagggccgtctgtgcgtgtgaatgaatggttcagtgcgtatgcgatggcgggtgtggcttacagccgtgtgtcgactttttccggggattatttccgcgtaactgacaacaagaggaaaacgcacgacgtgctgaccggaagtgatgacgctcgctacagcaacacatctctggcgtggggggctggcgtgcagtttaacccgaccgaatcagtggccgttgatgtcgcttatgaaagctccggcagcggtgactggcgcactgacggtttcatcgtgggtgtcggttataaattttgattagtaacacagcgttatgacagcccgccggttcaggcgggcntttttgtggantgggtatggcagcantacaaatatcangcgtgctgaaaganggtgcnggaaaaccaatacagaactgcnccnttcaactgaaagccagacgtaacagcaccanggtggtggtgaacacggtggcctctgaaaatccggatgaggcagggcgttanagnatggacgtcgagtatggtcagtacagcgtcactctgttggtggagggattcccgccatcacatgccgggaccatctccgtgtatgaagattctcaaccgggtacgctgaatgattttctcggtgccatgacggaggatgatgcccgtccggaggcactgcgtcgttttgaacagatggtggaagaagcagcgcgtcacgcagaggaggcgaagaagaatgccggagaagcagagacgtccgcgaggaatgccggcatatcagccagtaaggcggaagcgagcgccgcaaatgctgatacttcagcagaggatgcatcggagtcagcccggcaggcggcagaaagtgcagcctctgcaaagaagtcagaggaagcgtcctcgtcctcagcctctgaggccgctcaaaaagccagtgagtcattacaaagtgcaacagatgccgagttgtcaaaaaagacggcagaaagtgcagccggtaatgcagccagggatgcaacgacctcaacagaaaaagcccgggaatcagcagaaagcgcacagtcagcggaacaaagcagaatagcggcggaagacgccgtaaacagaattcccaccgtggtggggcctcccggaccaaagggggaaccgggtcccgcgggtcctcaggggccgaagggagataaaggagagcgtggagacaccggtccggcaggggcaaccggtgaacggggaccgggaggagatacaggtccggcaggtccgcaggggccgaaangcnacangggacancgggganagaccggtctgacgggaaatgcaggtccacagggtccaaagggagacaccggggcagcaggcccggcaggcccacagggaccgaaaggagaaacaggtgcggctggcccggtgggggcaaccggacctcaggggncgaagggcgacccgggggagacacaaatacggttccgtctggggccgatgagaattattgagacaaacagctatggctggttcccgggtacagatggtgcgctcatcaccggactgacctttcttgaccccaaagatgccacacaggttcaggggatgtttcagcatttgcaggtcagatttggtgacgggccatggcaggatgttaagggactggatgaagtgggcagtgatacaggcagaactggagaatgacatgaatattttgagaaagcttatgcagagtctgtgcggttgcggaaagcatgatgactgtgaaaacggacggtcacttacagcacaattgcgactgggaccggcagacattctggagtcagatgagaatggcattattccggagcaggacagggtaatcacacaggtggtgatactggatgcagataaaaagcagatacagtgtgtggtaagaccgctgcaaatcctgcgtgctgacgggacgtgggaaaatattggcgaaatgaagtaacccgacagcttcacaaaaccggagtccgactccggtttttgttgtcatgtccggtggatgtttgttaggaaagcaaagatggcaaaactgctggaggttttgtggttgagtatgccaatataattaatagattaaagagttagttgtgaagaaaatatggataaacaggacgacgaatgctttcaccgataaggacaactttccataactcagtaaatatagtgcagagttcaccctgtcaaacggtttcttttgcaggaaaggaatatgagttaaaggtcattgatgaaaaaacgcctattctttttcagtggtttgaacctaatcctgaacgatataagaaagatgaggttccaatagttaatactaagcagcatccctatttagataatgtcacaaatgcggcaaggatagagagtgatcgtatgataggtatttttgttgatggcgatttttcagtcaaccaaaagactgctttttcaaaattggaacgagattttgaaaatgtaatgataatctatcgggaagatgttgacttcagtatgtatgacagaaaactatcagatatttatcatgatattatatgtgaacaaaggttacgaactgaagacaaaagagatgaatacttgttgaatctgttagagaaagagctgagggaaatttcaaaggcgcaggattctttgatttctatgtatgcaaagaaaagaaatcatgcatggtttgatttcttcagaaatttagccttattaaaagcaggagagatattcaggtgcacatataatacaaagaatcacggtatttcattcggggaggggtgtatctatcttgatatggatatgatacttacaggtaagcttggtacaatatatgctcctgatggaatttcaatgcatgtggatcgtcgtaatgatagtgtaaatattgaaaatagtgcaataattgttaaccgtagtaatcatcctgctctacttgagggactttcttttatgcatagtaaagtagatgctcatccatattatgatggtttggggaaaggagttaagaaatattttaattttacaccattacataattataatcatttttgtgactttattgagtttaaccaccctaatataatcatgaacacaagtcagtatacatgcagttcatggtaaatgaatttgatatagtttattttgttgtaataaatgatttgcagggtattagatataaacatgaaaattccctcattacagtccaacttcaacttttccgccccggcaggatactctgctcccattgctcctaatcgtgctgaaaatgcctatgcggattacgttttggatataggtaagcgaataccactttccgcagcagatttaagcaacgtatacgaaagtgtaatacgcgccgtccatgacagccgtagcaggcttatcgatcagcatacagtcgatatgatcggcaacactgtacttgatgctttgagccgatcacagacatttcgtgatgccgtaagctatggcattcataatgagaaggtacacattggttgcattaaatacagaaacgaatacgagcttaacgaagaatcttctgtcaaaattgatgatattcaatcactaacctgtaacgaattatatgaatatgatgtcgggcaagagccaattttccccatttgcgaagcaggagaaaacgataacgaagagccttatgtcagttttagtgttgcgccagatactgactcttatgagatgccatcgtggcaggaaggactgattcacgagattattcatcatgttactggatctagcgatccatctggagatagtaatatagagttaggacccaccgagattctcgcacgtcgtgtcgctcaagaactgggatggagtgttcccgacttcaaaggatatgcagagccagaacgtgaagctcatcttaggctacgtaacctgaatgcccttcgacaggctgccatgaggcatgaagagaatgagagggctttcttcgaaaggctgggtacgatcagtgaccgatatgaggcgagtcctgatttcacagagtattccgctgtgtctaacataggatacggatttatccagcaacatgattttcctggattggctatcaacgataatttacaggatgcaaatcagatccaactgtatcatggcgccccttatatttttacatttggggatgtggacaaacacaatcagcaatgattcgtctttgcagtgacataaggttactattcatacattttaacggagttgatgatgggtaatcgtgcaacattgtatgtaaaggcaattcccctaattttactgtantaagtgaacatggccgggaacgagactatcagcatcatcggcttcggcccagtaaaaagaggctcggaaaaatgcacaataggcatcacacgtcatgcatggattcaaattgtacataattcaacagtacagctataaatcgtaaagaaactgcagtacgttgtgcacagaaaagtaccgtgattcactattgtacaggtccattgcagcaacaatattttgtgaattttgcgtgagagaaagaaaaggaataatttgtatataaacaattgattaatcaattgctggaaaataaataaaactgataattaaaggcttaaagcttgtattaaatcatatttaaaattttttgttttaaatgcagcgtgttattgtgttttttttaatctatcggtctggtacttgtaatcagtgagtatatcgcaccacttcaggatgctgcagatttagatattgcgacggatgagcagacatcgttactggcggcatggaaacagtatcgtatgccgctcaatcatgttgatacgtctgtatctccagatatcgagtgaccggtaatacctgcgttatagttcgtaaacgttcgtttgatgggatgctggaaggatgaattagttgccagatacaaaaagcaagagttcatttctaatttttgttgccatgttaggggggatgtttgttaaggaaatttagatgggtttattttgaaggttgaaatgtatgttatcgccatattctgtaaatttgggatgttcatggaattctttaaccagaaacctgacttcgcctgataatcgtgttttatcctctgtaagggatgctgccgttcattctgataatggggcgcaagtaaaggttggcaacagaacatatcgtgttgttgccaccgataataagttttgcgttacaagagaaagtcatagtggttgttttactaatctgttgcacaggctgggatggcctaagggggagattagcaggaaaattgaggtcatgctgaatgcatcaccagtgagcgctgctatggaaagaggcattgttcattcgaacagacctgatttacctcctgttgattatgcaccgccagagttaccgagtgtggactataacaggttgtcagtacctggtaatgttattggcaaaggggggaacgctgtagtatatgaagatgctgaggatgcaacaaaagtcctgaagatgtttactacatctcaaagcaatgaagaggtgacaagcgaagttcgttgcttcaaccaatattatggtgccgggagtgcagaaaaaatatatggcaataatggtgatattattggtattagaatggataaaataaatggagaatcgcttttaaatatttcgtccttgccagcacaggctgagcatgctatttacgatatgtttgatagactggagcaaaaaggaattctttttgtcgatacaacagagacaaatgtcttatatgaccgcgcgaagaatgagtttaatccaatagatatatcatcttataatgtttccgaccgttcatggagtgaaagtcaaataatgcaatcttatcatggcggaaagcaagatcttattagtgtggtattaagtaaaatttagtaattttatccagtgtagtggatttgttgcatggatggagttggtaacaaattgtgtggttggcaattcttggcggatcacggaaatgggcaatgtcgctgaggactggcaaatggctatgatccgctttattatcgggtttggtgaccgccttgacggtcacttttaaaaaaatcattttcacagagtggtaaacaggctgctaataagtagcattctcaggagtcctgatgcgccctacgtccctcaacttggtattacatcagtcatcaaggtcgagctcaatgtcagatacagatatcgagtctcttgtaaaagcatcgagcgttcaatggataaaaaataatccgcaacttcgtttccaggggactgatcataatatatatcagcagattgaagcagcactcgataagattggctctacagagacagggcgtgtactcctgaatgctattgaatcaatatcccgacttaaatcagaaacagtggtaatacacctcaactcttccagactaggagttatggcacatagagatatagatgctgagaaccatcgggggactggttccgattttcactgtaatctgaatgcagttgaatatccctgtggggaggggattagcgtggtggactttcatgcgactattgtttttcatgagttgctccatgttttccacaatttaaatggggagcgtttgaaagttgagagttcccgagcagaatcacaaaaatactctccacttttactcgaagaagccaggactgttgggttgggggctttttcagaggaggtgctttcagaaaataaattccacgaagagattgggatgccccgtagaacctcctacccgcacgactcagctcttattcatgatgacaatacagtgagtctgggattccaacaggtaagactgcatccattgctttagctgtgtttcttgtgctgaatatatattggtggggcaaacggaggcacacaaaactttgcactggattgcaaggctttgtgctattccgatagtggttcaggtggagtaccccaccttttcatcaagccagcccacccaccactgcatcatttctctgcgcttatagagatactgagcatggttgtaaattcagcaaacgacgtaatgtgtttgacaaaaaattagcgcaagaagacaaaaatcaccttgcgctaatgctctgttacaggtcactaataccatctaagtagttgattcatagtgactggatatgttgtgttttgtagcattatgcagtctattttttagactaaatgcattgtaatacattgatattattgggttttgctgtttcgcgttca

SEQ ID NO: 51 - DNA  (genomic), 2807 bp; double-stranded, linear
accatgtaagggcaaaagagtatcacaggcttttgcccattattcaggtaacacggtcagacatgcatgacatgtctgattttattgttttaataaatttgctttatgatctatctagtgtatctaaaatggcaatgaaattatttctccttgcaatttgaattattgttaataacattggttgatattcataaacaaattctgggaaaatctggaataaacatgctattgcataaagagtttgttcatcatctggtaaattattatgagatatgtgattcagtattagcttgattctgtccctgattttattattttcattgtctatagtgtatccgactatctccctaagcaaaataaagtgtgcagtcgtttcattaccgtatatctttagtagttctaataaactatcaaaaatcgctcatttcagcttattgatagaaagattgattgccagtctgtttagagccgtacagcagcaaactttcataaccaggttgatcctgaatttgcagtacgaaaagttaaaaatgagcgatttctgtaagactccccattttgccaggcttatgattcgcagatcattcaagtgcaaaggagcgatgtatggattgttcaaaatgcaatggttatgcgacgatgttattaaatatggtgcagggttctgacccggttaatttactggaattacatggtttccttgaacatttcgcatattatgtttcatttggcaaatttaatgctggccaccagcgctataatgcatttaaaaaattcgtcagtgagatttcggagatcagcgcaaatgatatcaatatgacgattaaaaccgggcaatccagacatgaaaatgtgatctctataaatatgaatgatgcaattcctcgtgatgagaaagggatcaccgttagaatagataatattaatggaaagaaaaacaactctaattcatcagatgtttttattccttatgtaaatacatttcccgacctcaaaaataaaatactcaggatgaaaattgaactgactgaaggtagtggtttttctaaaagtctttctgacagtcagattgagatgcatattctgaggactgttaattcgctaaatgttggcgagaaattgaatgatgataatcttgcagatcattctatattcactaacgaattctctgttattattccgccatcctattatgatgcaacttctgcagtaaacgctaataatattgtgagagaaaaactatttgaaagtgatagtaaagttaaagatatcgtcgatgatatgtctaatcatgacgtggagagcgaaaaagatatatttgtaatcggggggatgatagaaaaactgaattctctggcagacgaatctttcaatgatagtactgataacatacaaacagtaaaagatctgttaacgcaattaactgatggcatggagctcttcgcgctgcgggacatagtggcattcccatcaaccataatagcaaaattaataaaatccccacttaatagcgatcatgaacttgttatgcgcgcactggatacgtatctgtgctacttcagaaataaaaatctgaataacaatgcggaaataattaactttttccatgccctctttttaaagagaccagagttgatggttgctgaaaattatagatttattcaatttattgatttgctttttgaaaacggaaatgttgaagagaaaaacttagcatttgacctttatcacaattatctttcattatctgaaataaaacaattcgttactgaagaaattaaattgaatttcaatgagcagcaaggattgttagataaagataataaatgttatatcctgttatcatccgataactctgggcgagtaatgcgcttatcgcaccaggcgttaatctcaatgcttgagccagaggttaagaaaaagactatctggaataattactctatttatccatctttgcaggatacccatgaagttgtcagagatgatccagaaacgatttgtatgcgtgcatttcctttatttgcaaaaggatgggaatatgcgcagaaaaataagaaacatcaattgatcctcaatgctcttggattcaaaggttatattcgtgatatatttatgtcagcaataatgcgaaaaacagattttgtgctcgaatgcaataatcaaccgacagaacttaattcatcattttcctctttgatgaacgattcagatcaatggcaacagcatactctgaaagataaacattacgctaatctattaacgatgctggatctcaatgatgccagtgaaagtgataagtctaaaatatttttctgcctgtctgccgtatttgcaaatatttctcacagtaatgtctttaacggtattcctgatgcgtcaaaaactttaaaacgttatgcatttgctttattggcgaaagctcattctttagatgaaagtatgataagcaatcaaacttttaatacatacaaaacggtattgcttgatttcaataatctgtctaatgaagaggccaaccagttgcgcataagttcgttatatcgtgatatggtccgctatgcacaatatcgtttttctaaagttttatccgagtggacgccagacgcatggctgtaaagatcgcagcagaataatggcattgatggccctggctcaggccagggtcggcaataccggttcctgcgaagcgatgacggcggcaattgtaaccacgaaatgcggtatcacttgctgttttctgccctgaagactggcgctcactgtgccgtcgaattttcaatcaaatatattgcgagagggcgtgt

SEQ ID NO: 52 - dna  (genomic), 103 bp; double-stranded, linear
accgatgcctgccgcgcttggaaatctgtgcccgaaccgtaggccagataaggcgttcacgccgcatctggcgtctggagcaaatgcctgatgcgacgcttgt

SEQ ID NO: 53 - DNA  (genomic), 996 bp; double-stranded, linear
gaattagaatagtgttagtacccctgaatcaaggggtactaatgaatgtggtaaatcatttgcaaacattttactttgcaaaaacttccggcccttttattgccaatgtattcaaaatacgtagtgccgggccgctcggttttatttcattacgttcccatttcgagacactttcttttgacattcccattgtatgtgccagcacggattgtgacatgccgtatcgggtgcggatggctttgatctcttcacccgtcattgatttgactttggctatacgggcgctgacttcacgggctttgaccatgacggcaatggcatcaacctcactatcagacatcaggcccagtgcattcagttcctttgcatcttccagcatcatttgtaatttatcgctcatttttcacctcaatcaagaagccagtttcgatcaaatcctctatttgcttattgctaaaggccagaaatgcatttgccatttttttgtaggctgccagttcatcatcttcgatttctttgcttcctttactgcttagaccactcttggaccaaccatcataaaaaaacacatgatttgctgatttaaaaaagataattgttctggctccaccactctttccttgttggaggggtaaccgttttttgatgacaccgctacctaaatcagcctcccatatgccttgcatcacttcttcagcggcagccatgagaactttatcgtgaataccaagttttttcgtgctttggctgaatcgccttgccttatacacacccatacatccatccttgtggtaatgtttactatagtaaccattacgcttatttcaagtaattgcgatcaaaactttaatttggtgtgaaaaagtgagagttgcctcgagtacgattcatttttctcgatttatgcgtcaggggattttgtgcgtaagggtaggacatcgggaagggtagtagaggcagatcgaagaacaatatccttgttagatctgcctttag

SEQ ID NO: 54 - DNA  (genomic), 3515 bp; double-stranded, linear
aatgtaaatacatcattcaaatcaatatcacctcggcatacatccatccaaaataataatcgtgatcgatcgattaataataaccgatcgatcacggttatatattgctctatttttgcaaatcaaatcacaaataatcaaataagatctttaattgaactgttttgattactacagtgcacttaccgaatacatacagaggcattgcttagcgaaacacaaaatttcctgagacattattaacgtcagcagaaggttcatgcattgacaacggaaatgtacgcgtatggagggcgttccgacgatgtttgccaaattcatagatgttattcaaacgtttttaactgaaccggcaattttaattggtttgctggtgggtattggttatgcccttgataagaaatcgccaataaaaattattaccggcatggtcagcgccatggtgggattaatgatggtgttatttggtggtttccagttttccgcaacatttaaaccggtagcagaagccgtaagtaaagcctatggtgttcacggatatttaatggattcctacgcaatgaaagcggcaacgcaaattgcattgggggataattttggttatgtcgggtatgtatttgtactggcgttttttaccaacctgctgctggtattatttggtcggtatactggtgccaaagggatatttttgacagggaataccggtgtttcacattctcaggcggtattatggttgattgtcttttggctgggttttagctggactacatccattattattgccggaatattaacgggtgtattctgggcgttctccaccacgctcattgttaagcccattgccaaagttaccaaagatgccggttttaccattgctcataaccagatgttgggattgtggtttttctccaaattcgcccataaatttggtgaccctgaaaagcacgatgctgaaaacctgaaacttcccgggtggctggcgatttttaaccataacgtaacggctatcgccattgtgatgacgctgtttgtcggtggtttcttgctatcaacgggtatcgataatgtccagttaatggcgaaaggcaagccctggtacatctatatcatcaaccttggcttacagttctccatgtatatggtcattctgctgcagggtgtgcgcatgatggtgggcgaaattaacggttcgtttaaaggctggcaagatcgctttattcctaacgctattcctgctgtcgatgttgcagcgctgttacctttttcacccaatgccgcaacgttaggcttcgtcttctgtacttttggcaccattttttcgatggggatcttattactggttcacagcccaattatggtattgcctggctttgtacctctgtttttctctggcggtccaattggcgtattagcaaaccgcatgggcggataccgttccgtaattatctgtacgttcttgctgggtattattcagaccttcggtacggtgtgggctattccgttaaccgggcttgctgaaaatggcgtcggctggacaggaatatttgactgggcaaccgtatggcctgctatttgtgaagttctgaaatttatcgctgcaacattccatcttggtccttacgcgggttaattaaatattaagggtttaaaaatgaaagatacaattaatattctgtttgtctgtggttacggtgtaggcagtagcgttatgttacaaacggtcgttaaaaaagcgctgaccaaatatgatttcaaagttgaaatggaacataccgccgcaggtgaagtcggcggatttaccgactgggcggatatttttgctatttccaaaaaattactcgatgtggttagtcttgacccgaaacaagggcaatatttgattccgatagagaatattatggacggtgaaactattggtcagcaaatttatgaagtggttcagcaacattttccgcatttaattaatcaataaggtagggcgtaatgagagcgattattctgctgttcgatagtctgaataaacgttatctgccaccttatggcgatgcgttaaccaaagcgcctaatttccaacgtctggcggctcatgccgccacctttgaaaacagttacgtcggcagtatgccgtgtatgcctgcccggcgggagttgcataccgggcgatgtaacttcctgcatcgggagtgggggccgttagaaccgtttgacgattccatgccggagctgcttaaaaaggcggggatctatacccacctgataagcgatcatttgcattactgggaagatggcggcgagaattatcataatcgctacagttcgtgggagattgtgcgcggacaggaaggcgatcactggcatgcaagcgttgcgcaaccgcctattcccgaggtgctacgggtgccgcaaaagcagaccggtggcggtgtttctggtctgtggcgccatgactgggcaaaccgggaatatattcagcaggaagcggattttccacaaactaaagtgtttgatgcaggctgtgcctttatccacaaaaatcacgcggaagataactggttattgcagatcgaaacgtttgatccgcacgagccgtttcacacaacggaagagtatctttccttgtatgaagataactgggatggaccgcattatgactggccgcgtggccgggtgcaggaaagcgacgaggccgtggagcacatccgttgccggtatcgttcgctggtgtcgatgtgcgatcgcaacctggggcgcattctcgacctgatggatgagcacgatctgtggcgagataccatgctgattgtcggcactgaccacggctttttactcggtgagcatggctggtgggcgaaaaaccagatgccttattacaacgaagttgccaataatccgttgtttatctggaacccgcgcagtggtgtaaaaggagagcggcgacaggcactggtacaaatgatcgactgggcgccaacgttgtatgacttttttcaacagccagtgccgcccgatgtgcaggggcaaccgctggcgaaaacggtcagtcacgatgaaccagtacgcagctcggcgatgtttggtgttttcagtggtcatgctaacgtaactgatgggcgttatgtgtatatgcgtgcagcgctgccggggcgtgaggatgatattgccaactacacgttgatgtcctgcaaaatgaacagccgctatccggtggatgagatgcgggctttatcgctggccccaccgtttcgttttaccaaagggttacaggtattacgcatcccggcacaggaaaaatataaggggttgaatcagtttggtcatttgctgtttgatctgcaaaacgatccgcagcagctacatccgattcatgatgatgtgatcgagtcccggatgatcgcgttgctgattcagttgatgaaagataatgatgcgccgccagagcagtttcagcgcctgggattagcgtagagaagtgattttgccggagtgggtgttcgcccactccggcaaatgaataa

SEQ ID NO: 55 - DNA  (genomic), 2561 bp; double-stranded, linear
ttgctgtctgcgtcacactacgaccaaacgctatcagattatttaatacattgtttttaatacaattctgaaacaatctgaacacctgattgggtttgagtccattgctggcgacccactcaaggttgctcgtagctgacttacttaaattacccaaacaatagacagtgtaaaccatttgtgaggttgagcgtgttatatggctgaaatgatcatttaaggtaaatatgatagttctgaaatggtggtataaatcctcctgtagaggttaagagcatctgcaagaagccagtttcacatttataacgcgtgataaatgaacgcggttattgtctaatcattacaaatttttcacatgcgataagagatcctgctattaagatgattgccaaaattacgttgtatttttgaaaatgagcgaaatttgatagtcccagctttgacttttgataatattatttatgctacagttgtgggtataaaatataatctttttgaacaagtgaatttgagctaagaataaatcaagttgtttcagtgtttcgttaattaatatgagtataaaaggtgttgtgcttttataataataaagcgcgaggagttcggtggagtatcgtttttcttgggtgatttttaatatgataaacaatatatctgatcaagcgtcatcatttccatgcacacaattgaatcaaagtgataatttcctcgattcactgagggaatttttcgcgatattaaattccagtcgtaagggtgagttgtctacatgggataccatctacttgcatctgatattagtaataaatgctgacagtgatctcataaaaaatgatgtgttgctcgcggaaaatattccaacagcggattatcaatttaatacattttttagtaatgctttcgagactgatgttaaaaaatatctgggtaaatcagaagataacgaagttgaaataaaaacgggtaatgaaagaatctctattggaatacgtaacagatcgaatggaaaacttgaaagacaaaagtttcttttcccactggactatgagaataaattacaacatcaattagacaagcattttacgattgaatcgcacccattattatacaggcatactatgggtagtaagattgcgaatgtgatttttgaaaaattatacagtcgtattgactttaacaaagaacaatatatatcctttataaaggacgcgtttcttcatttttatgattatagcaggcgatatgcaattaatgaaaatattgcaaaagacgctgtaacaaacaatatcgcattgatgagcactttttatgacagtgataatacgtcaggtgaggttttaaataatgattttacagaagagtcatttgaaactgcgttagatgtagagcatacaatagtgcttggatttgctgatgataattttgaaacaaaacctgttcattatcaggatttattaacacgatttagtgcctttcaagataccgtgtttaatctgtttcctgaaatgcactcttcgcattacaacgatatttgtagcgtaagtgtggatatgacaaagggaacgcaatgcatgattcacttgatggtgaatgaagaagttttcatgtctctgcctgttccagttgccacgatggtacgtgaagatgcaagtaatttaatcaatcttaaaacactactcaatgatggttgctttattaaatatagtcattttaatgacgtggcattaataaagcaaaacataagtaatctctatttatcacacactgttgtgaatgaaagcatattgaaaaaatgttgttttgaaaacggcagtttaggtgatgttaaaataacaaataacaaatagcaatatagtaaataatgtattcaaaaatatttcgtttagatctgttaaaattaacaacgtaaatactcattctttaaaatttattaactgtcatttttttaatgttgatatgataagagttaatttcagcaaatgtctttttcatgactgtagcatgcatggtgtcaagataaaaccatggttgccagtaaaatggacaaaagagttaataaatgattatttgtatggctgtttactctctctgtactctatctgtgcaagagatatatataatatgaacgccgggaataacgtgaaggttgctgcggatgcttttcttgaaatactttattctcttaaaaataaatattgtattaaactattaagcgctcaggatcgggcgtttatatacgaatttgcaagaatgatcttcgcttatattaatgacaaaagcattgagatcttattactttcttgttttgcggcggcggaccaaaaagcaatccagcggtatatacctcaggcgcaagatggggaagactttaggaatcatttacaatataagttgactcttcccactcattaatgttgccggcacaacataatagggcaggtaagcggtgctccataatgaaaccaatatccggttacgaaacagataattgtacaggcttatgtagctgtttttgacacaatgagatgatttcctaaactgatcaaaaccttcttcccaac

SEQ ID NO: 56 - DNA  (genomic), 349 bp; double-stranded, linear
agggggatttttaattctatatgagtgtttagcattgttgcgctcctttcatgtgcaatgccatataaagccactggcgcagggagcgcgcagggntcttccagtcgccgccgccccctgcacccccgggctctggcgaacaaaatcgccgctgcgcggtaccttcagcttatccccttcggcaaccgggtcgggcgcgaggtaacgtcctgtaagacgcgccctcagcccacatccatgtgggctgccccggccttcggggaacgcttcagcgattttgacgccaccaatacccgtgcggtttgtaatgtcgaagataaaacaaccagggcagataaaatgccaatgc

SEQ ID NO: 57 - DNA  (genomic), 87563 bp; double-stranded, linear
accgcctgaaataaatctgacttaatccaggggtgttatataatttcattataaacaatgtattacactttttgttgtccgatattatctaatgtattcttagtgaagcgagagactaatggcatactggatggcataccagagtgacgggaattagcgtatggcagtattgacggatacgaaagcaagacatatcaaacctgatgacaaaccattgccccatgggggaattaccggactgacccttcatccttcttcagtaaaggggcgggggaaatgggtttttcgttatgtaagtccggtgacacaaaaaagacgtaatgctggattgggaacttacccagaggtcagtattgctgaagctgcacgtactgcccggataatgcgagagcaacttgctgcaggtgatgatcctctggagattaaaaaggctgaatctgagaaagtcgctatcccaacatttgccgatgcagccaggcgtgtacatgcagaactgtctcctggatgggaaaatccaaagcatgtaaggcagtggttatcgacgcttgagaattacgcgtttcctcaactgggagcaaaaacgctggattcgattacggctgcggacgtggcagaaacactgcgtccagtctggttaaccttgtcagaaacggcaagccgggttaaacagcgcattcatgttgttatgcagtggggatgggcgcacggtttttgtgtagcaaatcctgttgatgtggttgaccatttgcttcctcagcagacaagaggacgtgatgaacaccaacccgcaatgccctggaggcagttaccgctttttgtggcgaccagtgtgtataccgatgaaccttataatgttacccgcgcactgttattaatggtgatacttacagcaactcgctcgggcgaagccaggggaatgcgctgggctgaaattgattttcataagcgggtatggactatacctgcagaaagaatgaaagccaggatacagcatcgtgttcctttatcccggcaggctatttacattctggaaaatatacgtggcctgcatgatgaactggtgttcccttcacccagaaagcagcagatcctttccgatatggtgttgacaagttttctgcgtaaaaagaaagccgtcagtgacattccggggcgagttgccacggcacatggttttcgctcaacattcagggactggtgtagcgaacaggggtattcgcgggatctggcggaaagggcgctcgctcatacgctgaaaaataaggttgaggcggcatatcatcgtactgatctactggagcagcgtgtaccgatgatgcaggcatgggcggattatgtgatgtctcaaattgtgaataaataatagtgaaaatgtatattgtacgatcatgatttgatatgtgatcgtagcagtagtaattaagaaaccgcttttatgtcaaatgtattgagctgataattatcagatcgtcaggaaagcgtattttgattaacaggggattacttaacaatcccctttttataaaaaataatttgcctgtttaactcttcactcctgctgagactgaattattcctagtgcgtcataaatcagtcttctgcgtagtttattgtttttatctgcaccatataacataaatatattttcaactttttcttcaggtgttctgagataatggataagaaaggttatcattccaacacaatggaataaagtgaatccatcaaacaggcttatcaggtttccttttttttcccgtgttgtaagtattttttcgcgggtaagaatatttgccagttcatggggggctgatatgtttctgctgtctataatgtcatttattttaccaagggctatatcaacttcctgtaataggttatttatcatagctgagtgaatgttattggtttcatgttcctgacagtttatgaacttataaatcattgagttatacagaaatattactcttcctaataaatatgtgtttgtgtcattttgaagacaggactctgggtattcgtgatccagtgaaataaggttaatggactcgccctgataagtcataaaataattgatgtcatttaataatgctcggatatttacatgatttttactgaattttattttaaatgctatctttagtatagcaaacgcggcaatgataaatccaaaaggtaatttctcatagttcagtttattgatggtgcgatgaacactttcagtctttcctgaagtaagttgtctcaaacagttaacaaattctgtatagccatttaagacataatggcatgaagaatcttttaaagagttttctatgttttgtaatgtgacgccgttgttcaatgtataaatgtaaccgccaaagacaatgttttcaatctcaacgacacaatttattgttttttgttcaggataaagataaatatcagaaatactatagtctcgtattgcgtcaatggcatcccacgataatgcactgtcaattttcagtgtataaaatggtgagttctcattaggaaagtaatatatgtatttgttcagtatattcattacatctattgggttggttaaatataataactggcattcatattctgaaacttctctttcgcttatcagcattttatataaagttgccagggtgcttgttaatgaagttcgtctttcgaaagccagtaatatagtgagataataacatgcaacctgaactttatctaagtcagaaattattttttccttgtcttcattacttaaataaagcagatgtttacaggtttctttgcatgtgttgatagttgcgataagttttgtttttcctggtgtactgtttttgcgaatattacgaatgaattcatatacgccatcaaagatatctttgaaatgcgcattcgctggcgtgtatccggataaacataacttaacgtaatttcgcagatatgtccttgcagcatgatatatatcatcctcattatccggtatctgagtgagaaaagaatgaatatgatagtaaaatgccatctcattatccgggcgatatgtgttcctgatgtcgagtgcgagaatcattggtacaatgtcattaaaatatttttgttttattatttgatgtgttttgtctgtaaaaacagaatagtgcattagcttaacatagagatcttcatatctcctaaatataacttttcgttgttctttactcaatacttgttctttatcaataatgtttattaattcatcaaacatgtcgcccagtgaatgttgatgtgaggaaaaatttttaatatttcggatgtcacggctattctggtttttagccagaacaccaaaacatgaaaagacatcatacattatagtgataaaattatacataacattctccttttattgcactatataaaattttaacattatatcattttgcttttctgttaactggttttcatttttgaatcaatattttctgaacagggtaatagtacacgtattaacagattatgtcagaaggccccggtgatgccttctgacgatagattaatgttgtattctattggtatctggagaccatatggcaacagttacagtatattctccccgctgtaattcctataaagtgtaccgttatgatcacagcacctcagatcatgagcgtttccagtgctaatcctgcaaacgtgtatttcaactgaattacatctacgaaacccgaaaaccaggcattaaagagcaaattgttgaaatggttcataacggagccggggttcgcgatagctccagaacgctgaaggtggatatcaacaccgtcattctcactttaaaaaacgctcaccacgtaaagtaaccatatctccagccgccagtgtcgatgtggcacttatctgtgaacttgatgaacaatggagttttgtcgaaaacaaagctcgtcagcagtggcactggtacgcgtataagaccaaagctgacggtgtgctggcttacacttttggtcctcgcactgatgaaacatgccgtgagttgccggaattcctgaagccattctccgcaggcatgataaccagagacaaccggagcagttataccagagaaatgccacaggataagcatcttgtcggcaagatatttacccggcgcattgagcgcaacaatctgacacttcgtactcacatcaaacgacctgcccggaaaacgatttgctttttacgctccctggaaattcacgaaaagccattggttcatttatcgaaaacacatgtactactgacaggagtcattaccagggcctcttttgctgtttttttgccatgaatgataatgagaatcgacagcgataagggaaaagtaaaataacactaatgctgtcgttttctatcatattgatttttaattatttattgtcttttttctcaacccatttttttacgcagacaaatttacccggggaatacaaactgtaacgacagttcaccacactatgggggataaaatgccagatcaatccggacactgcaggactccttcacgcatcttacggatgcctgaactgagccaattgttaggtatatctcgttcgacaatttacgaaaaaatgaatccgttatcgaaatactacgatgcaaccttccccaggccggtacgtcttggtagtggttctgtgggctggcgttcatcagctattgacgaatggcttactttacatactgtacctgccagatcagcagtcaaaggtgttaatgacgaagtgagacatacgctttcttcagatatgaccatgagcagataagtttttgtcatcacgtgatcacctcaggaggaaaaagaagcataagaacaatttagccagaagtttaattgataaacagaatttccagcattcattgttgaaagagcagctattgtcgctattgtagcggtaattgctgctataaccgaaacgtattacgaaaaaggaagcatttatgccttacatcaaaccggatatgtcgtattcagtatatgcatgaccatcaatgatagggaaggcaataattaaagctcaatacaataaacaagtacctctgactctggttgcaatgtcagtattaacagcgatgtcaattgcctgtcagaatcaggttgacgtatgcagtcccggaaatttacgtggggccgttaatatttacactatggttctggagaaagggaaaagaccgggggaaaggtattagtgaaataatttccggaggtattaagaatgagaaatatgaatgatatttcgtggtgaataatacagtcttcactgaattaaccttatcggtttattaaacatcagatctacaaatgctctgtatttctcagagcatcaggtctgaatagcagctattttcgctattgtagcgggatttgctgctattttactaacccattaatgaaaagagaggcttttatgtgcttacttgcaccagaaaatccttatccgatatatgcactaccaccgctggtgagaaatgcaataattgaaactcaaaaaaatacacaggcacctttggctatggtggcaacatccgcattaacagcgatctcaattgcctgtcagaatcagattgacgtgtgcagacctggaaatttacatgggcctgttaatctttactctctgattctggctgattccggtgaaaggaaaacgaccgtggataaagtgtttatgaaagcattttatctcagggatgaagccctggcggatgaatacgcgaaactggttgagaattacagtacagaaaaggaaatatgggagcaaaaacaaaaagcgctggaatcaaaatttcataaagagattcgtgccggtaaagattacaaggcaacagaatcagagcttgaaacgcatctgaataaacctcctgttccgccgcagatacgtcgaacaatttttaatgagacaacgatagagggaatgttaaaatattactccgatagcaatcgctcttttgctcttgtatccagtgaagggggggtaatttttgacagccgggccatgagtaaactgggaattattaacactttgtgggatggaggttctcttttcatcgacaggaaatcatctcccggaattaatttgaaggagccaagactgacgatatcggtgatgattcagcctgatgtttaccacaaaggtttttgtacgcgaaaaaaagaaattgtgaaaacgtcaggacatcatgcaaggtttttgatgtgtcaaccaacatcaacgcaggggacaaggataatgatcaatgagcttattgatgaaagtctggcgatgagtggtgaacgacgttgccttcacttttctcctcaggctgccagaatctggacggattattacaatgatgtggaatcgaagctggggggattggggcctttaagacattgccgggaatatgctgctaaaaatgcagagtatatggcaagactggcaggacttatttaccattcgagcggtgaagagggggagatttccccttacactgcagaaatggcgagagaattagcaatatggtacggtaatgagtatgtgcggttgtctaatccgttaacttttgacaactctgccctgaccgtacctgtgcgactcattccagaggagcttgaacttttcaactggataaaaagctattgtattgagaaggggatcctctgtatgaaaaaaaatgacattttacagcgtggtccgaaccgtttccggaaaaaggataaaatcaactggttactggatttactgtatgaacaaaacagagttgtaccggttattgagggaaaaacgttgtgtgtcgcacctaactttgacctctgaacgacttaatcgttgagtacatatagtttcctctgctacttgcggaggagactaatgtctttaccatgtcagcgttgtattagaaaactctggtacaggtcagtcagtaaatataactggtgtaaccactatttactattggatagagtgttgctcaggatattgtcggctttagtctgaggtgaggtggggccttcattgttttcgtgttcaataaataatttaggttaattagtattattagtggaagttatgtgatctgttatgttgtcttgtacgcacttaacactggttacgtaccggaacactattagagtatgttatggctctgttacagtttataggtatgaaaaaatataatctttcctgtatgaaataatattcttatggtgtgtggggtatggtctgtataccatcatttttatggtgaagttaaatatctgtagaggccttaagctgggtcgctgtttttacttaatggtacagaagtattaatagcggtgttgcctgtggctacccgatactggcttttgtgaatgtcagattacttcctgtaagtgattgaatggtacttccttaaactcaattctatgaggtgtgtttttaccattgtaattcgtactggtcctcagtttaagtgagtcttactgtactctgaaatattacctctttggagtaatgaggtaatacgaaacagttttatcaggttgtctgtgctgctggttacctcgtttattaatgccgcggtacggcgtttctgtactctcagtatttatgtaattccaccttcctgtaacttttataaagtaaggactataaaatgtataatgctaatcccaattacgaaatggacttcatgattctgaaagacgtgaatgaacacatggaaggtctgtttcaacgtttttctaaactgttacctttcagaattgattttgcctacaggaaagacacgcccagttttggtcattcctgtaggcacagtatgtgtattgaaatgcaccgcttacttagtgaaacccaaacgatgctggcgggatattactgggtaatggaatatacgtcaaacaagggacttcatattcattttatcggctacctggatgggcaacgtcacaacaaatcttatcggatatccaggcaactgggagatatctggaggcggatcacggaaggggagggttattttcacctgtgcagggctaaagacaaatacccggtgcgtatcgatcacgtaattcactatagtgataaatctgcggtagacgacttacgttacgcccttagctatctggccaaacaggatcagaaagaacacggtattattctgaggcgtagcaggcttcccgaaaaaagtaaccggggccgaccacgacataactgaattacagctgtattaggtattagaattaagtttctgtaagttgttgggaggtgcttgagttaataggcagaagagggcggggcgctttgtcatcagtgtaggggacccgaatttctgccgtggtgcctcagtggatcggatacaggtaacgaatatggttcataaatctgacagtgatgaattagctgcattgagggcagaaaatgcccgtctggtctcattacttgaagctcatgggattgaatggcgacgtaaaccgcagactcctgtgcagcgcgtttctgtattatccaccgacgagaaggttgcattatttcgtcggttgtttcgtgggcgtgatgatgtatgggcacttagatgggaaagtaaaaccagcggcaaatcagggtactctcctgcctgcgctaacgaatggcaggcgagaatatgcggtaaaccccggataaaatgtggggactgcgctcaccgtcagttgattcctgtatccgatctcgtcatctaccaccatctggccggtacccatactgtcgggatgtatccgttgctggaagatgattcctgttattttctggcagttgattttgatgaagctgaatggcagaaggatgcatccgcattcatgcgatcctgtgatgagctgggtgtacctgctgcgctggaaatatcccgttcacgtcagggggcgcatgtctggatattttttgcctcacgagtttcggcccgcgaagctcgccgtctggggactgctattattagctatacgtgtagtcggacccgacagctgcgattggggtcttatgaccgattatttcctaatcaggatactatgccaaaagggggatttggtaatctcatagcgttacctctgcaaaaaagaccgcgtgaattggggggaagcgtttttgttgatatgaatctccagccttatcctgatcagtgggcttttcttgtatcggtgaccccgatgaatgtgcaggatattgaaccgacgatattacgggctacagggagtatccatcctctggatgtgaattttatcaacgaagaagacctgggtacgccgtgggaagagaaaaaatcatcaggaaacagactgaatatttctattgcagaaccgctgaaaatcacgctggcaaaccagatctatttcgaaaaagcgcaattacctcaggtgctgattaaccgacttattcggctggcagcatttccgaaccctgagttttataaggctcaggcaatgcgtatgtcagtctggaataagccccgtgttataggttgtgcggagaattacccgcaacacattgcgttgccccggggatgtctggacagcgtattatctttccttagggacaacaatattgctgcagaattaatcgataaacgatttgccgggacggaatgtaatgccgtttttatgggaaacctcagagcggagcaggaagaggccgtttcggcattactccgttatgacactggtgtgctttgtgcgccaacggcttttggtaagacagttaccgcagcggcagtgattgccaagcggaaagtgaatacactgatactggtacaccggactgaattgctgaagcagtggcaggagcgtctcgcggtgtttctgcaggccggtgacagtattggtattatcgggggaggtaaacataaaccctgtggcaatattgatattgcggtggtgcagtccatatccagacaaggagaagttgaacctctggtcaggaattatgggcaaatcattgtggatgagtgccatcatattggcgcggtttcattttctgcgattctgaaggaaacgaatgccagatatctgcttggcctgacggcaacaccaatccgacgggatggtctgcatcccattatttttatgtactgtggtgccattcgccatacagcggtccgcccgaaggaaagcccacataatctggaggtactgatccgttcccgttttacatctggtcatttaccatcggatgcgagaatccaggatattttcagagaaattgctctggatcatgacagaacggtggcgatagctgaagaagccatgaaagctttcgggcaggggcgaaaagttctggtactgactgaacgtacagatcatctggatgagatagcatcagtgatgaattcactgaaattgtctccctttattctccatggtcgactatcgaaaaaaaagcgtgcgatgctgatatccgggctgaatgctcttcctcccgattctcctcgaattttgttgtcaacaggcagacttattggtgagggatttgaccaccctccgctggatacgctgattcttgccatgcctgtgtcatggaaagggacattacagcagtatgcagggcgtcttcacagagagcataccggtaaaagcgatgtcaggatcattgattttgtggataccgcgtatcctgtgctgctcagaatgtgggataaacgtcagcggggttataaagcgatggggtacaggattatagctgacggcgatgaatcagtgatttaattttaaggagtactttaccctttttaaataatttgagctccccgggttgttcgggcaacaaagagtcccagtatacaggcttcaggaatatgttgtagtatcaggcttttcatcgctttaaaatgactaccggcagtgagaacgtcatcaaaaataacaatctagggcctgcacccttccagtaattgttcatccagttggtagtttgccataatcgcttctggtaagggccggtttgttgcggtatgagaggctattgttgatacgttttgcacaaccagttcccagaaatccagccatggttcgtaggtttgcgcaattcgcagaatttctgtcatacggtcatcgtaagcggcatctgtacggcatttggatggtggtacgggaacaaatgtgtattcctcaagattaccgatatttgatatgagcatctgagcaacatactcaatagcagcctttttatagtggtaatcaggctacgaaagtacagcgttttataaattgtctcaggtgatattcgcagcgttttttgacgtggttttgttcgccttaaccatcctgatatttgctctggagaccatttcatctccagcttttccagaacaagctttcgcaatggtaaattttgatccagtaagcacggttttggccttttcgccattctgttggctcggttattagcatcaacagctttgtaatagcgtctgccccgattacgcgtaagcgtacagcgagggccgtattgacggggatgtgttattcagctggcagtgctatgcgccacggaagcagttcgctgacccggttgaccggccagtctgctatgacgccaagcacatggcgaaggtagctttctggatccacgtcattcagtttgcacgtcccgatcaggctgtacagtagcgctccccgctcaccaccatgatcagagccgaagaacaggaagtttttacgacccagactgaccgcccgcagggcattttcagcgatgttgttgtcgatttccacccagccatcgttcgcatagtacgtcagtgccggccactggttaagtgcgtacgcgaacgccttcgccaactctgagtgtcgcgacagggtcttcatcttttcacgcaaccagctttccagggatttcaacaacggtttcgtttttcgctgacgttcagcaagccgctgctctgccggcattccccttatatccgcctctatggcgtacaactgaccgatctgctccagggcttcttccgtcagtgctgacgggatgcggacgtgcacatcgtggatctttcggcgggcatgagcccagcaggcagcttccgttatcccaccattgcgatacagctcgttgaacccggcgtacgcatccgcttgcagcacaccgctgaagcaggcaagatgagtctgcggatggatgccttttctgtccgggctgtaagcgaaccacactgcaggtgccaacgctgaccctgcattgcggtcatcacgaacatacgcccacaaccgcccggtcttcgtcttcttattacccggcagcagtacctggaccggggtatcatcggcatggagtttgccgtcagtcatgacatagccatgaagcgcctcttccagcggagacagcagccggcagcatgcatccacccagcccgacagcagtgaacgcctcagctccacaccttgccggccgtatatttctgactggcgatactgcggggtgtgctctgcatacttcgaggtcagcacgcgggccagcagccccggtccggcgataccccgctcgatgggccgcgaaggtgcaggtgcctgcacgatggcatcgcactgagtacaggcatgtttttcccgtaccgtccggataacccggaaggcgctacgcatcaactccagctgttcggcggtatcctcgcccagatagctcagtgaaccgccgcagttcgggcagcacggcgccgcaggcaacagtcgcttttcgtcacggggtagtgattcagggaacggcttacgggtgcgggtctgacgcaacggacgctgtactgccgggtcatacaccctaccagtcagcgtatcgctctctttctgaagccggttcagatcggcttccatttgtgcgatacggcgggagactttttcggaacgactgccgaagttcatccggcggagtnaatccagntgcgccngcaganggtcnanttcgcgctcccggtngctcagcttttcctgcagggcgnggatcagcgcttcctgttcggccaggcgctgtttcagcaggaagatgtcgtcagaagagatgtcgttcataagctcgtattttaccgggcttattctgtgacaaccaggataaagagatttacagcatggtcagggaggtcagcagccgcttaggctgtcgccagtcgataccttccagcagcatcgccagctgcgcctgcgtaaggaacactttgccatcacgggctgacggccaggcgaagcgcccacgctccagccgtttggtcaggaggcacagtccgtcaccggtggaccacagcagtttaacctgactgccgctgcggccccggaaaatgaaaacatggccggacatgggatcgtctttcagcgccgtttgtactttcgcagccaggccgttgaagccatttctcatatcggtgataccggcaaccagccaaattttggtcccgaaaggtaacgggatcatcgcttcagttcctgtatcagcagagtcaggagcttttcgctgacattgccattgaancggagcgtnccgtgccggnangttacctcacagctgatactgagggtttccgggtcctctgcgagcgattctggctgttcggcagctgcatcgagagtcacaggaagtagctgggggctctctgaagaaggtaatagcagctttccctcgcgccattgttgtcgccatttgaacaacagattggcgttaatgccattttcaagagcaagttttgagatggatatcccgggttcacaggaggcagcaacgagctgctgtttaaattcgggaggataattagggcagccttttcgcctgccgggagtcacatttttctgcatatctgatactttggttcccactacttatttggtggacaccactttgtctaattcgtcagattctgaccagacggttcaggctgtacgcttacgattacgctgaacttcacgtgagatcgtcgaaggactgcgattcagcgcagtagctatcgcacgaatgctcattttggctgacaaaccagctcgtatctcctcgcgctcagacagtgtcaggtgagctacagcccgcttacgctcatggggttttatgccgccagtatcccttaacatagtgaagatcgttccgggttttgaacccaggatattcgctatttcactgaagcctgttccgttcttccatagttcaaaaacagaggctttttcctctgctgtaaatgttcgtctcattcaaaaaacctccgcaaccccatgttttcacataactgttgcgttgaccaattgaatctacaacagcgtattttgcacaggagtcgctgaaaaatacgcgttaatcgaacaatggcgacaacaatttcccattgaagcgatgtgtcaggtatttggtgtatccaggagcggttattacaactgggtacagcatgaaccctcagacagaaaacaaagtgatgagcggctaaaactggagattaaggtggcacatatccgcactcgcgaaacatatggaacccggcggctccagacggagctggcagagaatggcatcatcgttggtcgtgaccgactggcacgtcttcgtaaggagctaaggctacgctgtaagcagaaacgcaagttcagggcgactacgaactcgaaccacaatctgccagttgcgccaaatctgctgaaccagacgttcgctcctacagcaccaaatcaggtctgggtggcggacctgacgtatgttgccacacaggagggatggttgtacctcgctggcatcaaagatgtttatacgtgcgaaattgtcggctacgccatgggagagcgcatgacaaaagagctgacaggtaaagccctgtttatggcgctcaggagccagcgcccacctgccgggctaatccaccactctgatcgaggttcacagtactgcgcatacgattaccgggtcatacaggagcagtttggtctgaaaacatcaatgtcgcgtaaaggtaactgttacgacaacgctccgatggaaagcttctggggaacgctgaaaaatgagagcctgagccactatcgttttaagagccgggatgaggccatctcagtaatacgggaatacattgagattttctacaatcgtcagcgtcgtcactctcgtctggggaatatctccccggcagccttcagggaaaaatatcatcagatggctgcttaaaaaaagaacaaatggtagtgtccgctattgtcagtacacctcaaccatctggcttgaacctgcgagcgaacgcaccgttttcctgcagatcaaaaacacgtcggataaagacatgagtggactacagggaaaaattgccgatgcagtcaaagccagaggttatcagatcatgacttccccggataaagcttactactggatccaggctaacgttctcaaagcagacaaaatggatctgcgtgaatctcagggatggctgagtcgcggttatgaaggtgcagcagtcggagctgctcttggaggtggaatcacagcgtacaataccgggtcggcaggtaccactctcggtgttggactggctaccggtctgattggcatggccgcggatgcaatggtggaagatataaattacacaatgattacagatgttcagattgccgagcgaaccagaaccagcgtcagaacggataatgttgcagctttgcgtcagggaacatcaggctccaaaattcagacaagcacagaaaccggcaaccagcataaataccagacccgggttgtatccagtgccaaccaggttaatctgaagtttgaagaagctaaacctcatctggaagaccagctggcaaaatcaatcgccaatatactctgatataaatatcccggtggccattcacctggcctccggccctcttagtctcaacgttcagacaattcagatattattttccctgtcacaccatatacccatgccggaacagaatctaatgacggtaccagtaaattcttcagcgttcggtttgcctgacgcccgtagctgtatttgtgtctgtttcttcttatacaagagcagtagtacaatttctcttccagagtcagttcaactttaggacgtaaccaataaagatctcttccactataaaatggtgaatcctgtacaaacgattccataacagaacctcctgctgctacagttaacacagctgctggcatggactaataccatcttttaatttaaccctggcggagacgccattatttttggacgttcttgaaacaaaattaattcctgaagaatctttctccagtttattcagctcaagattcagtccataattaacgtcaaataactctgataaaggtatcagtttatgttcaggataatgattatcccgacgacaacaaatattaaaatcctgcatattacccgacatcaggagttcaaaaccgtccccggcatcattcatactggcagataaattcattacccagtttagtgctaatcaacaggtacggcttaacttacaggaattccccgggaggggcggactcatcctcagttagcggcaaaatcgcatcacagccaatcgcctgtctcgattccccatcggcgaacaatgtatgtggccacaaaatcctggctggctcagaacgaagagcatctgagcaaagaggtcatcaatctggtatgaatatctggcagaaaatatcccctgaatccacaactgctgtgcatatctgctcaaatcagcatcaatcataaaccagtaatcacagtgcctgtgattgggttacaggaataagtcccccttcataaggcatatcatcaataccggtgaaggaaaagaaagcatcagatggcctgatagtctgcgtcagtcaatgacatcagtgctttatccggaacaatgtatccatgttggcgacagagaaagccattgccatgaacagttttgtttatccccggaaagtcatttctgttacaaatttatattgacaaacttgctttcgatgagaaacatactatttcaatgaaatgcagaatgaggcaaaatttcgttatgttttttaattcccgaaagaataaatgtggcttattacaaaatcctgttaatgttaactgatattttataatgcatattcagacatataattaaataagaggtatttatggctaatacgaccactggtgttaccagaattattaaagcagcgggttattcatggaaaggcttatgtgcggcatggcgctatgaagcagcctttcgtcaggagtgcattctggttctgtcagcactgataatatccttttggctggatgttgactctgttactcgagtattactcattggttcggcaatgatggtaattattgttgaaataattaacagtgcaattgaagcagttgttgacagaattggttcagaacatcacgaattatcaggcagagcaaaagatatgggttcagccgcagtgttgattacgattttagttgctatcattatatggggagttttattactttcataacgcccaacatctaaattattcacagttacctggttaatatttacttaaggataagaggtattcacctcttatcctcagaaaaatgtcagtatctatctgcaggaggatataatatcatcttctttattataaactgaagtatttacattccataaccccagtaacgatgaaaatatattatcatgacttactgttctgtttagagcatgttctgacaaacaattcaaatcaatttttttagaggaaacgaaccccggagacatccaggtaataagaggcacatgcgtttgctcagctggagcaacattatatggtgttccatgtaagtataatccattttctcccagagattctccatggtcagagacatataataaaacagtatcatactcatctttatattcgataagcttgtcaattaattttgatattatataatcagtatagcgaattgtattatcataggtattaatcaattgctcatgcgtacaattttcgatatcactacgatcacatgttggtttaaaatatttatgtgactcaggataacggagatagtaggtaggaccatgactacccatcaaatgaaatacgataagtttatcctctgagttattatttatatactcatcaatattttttagcataacctcatcataacatgagtttttcttgcataatgtattatctgaatttgatggctcaatattaattgtagggattcgcttacatacacctttacatcccccgtcattttcaatccagagtaaatttacccccgttctgtacagaatatccagtacattttccgaatttaccgctttgcgggaattgaactcttttcgcttcatatctgaaaacatgcatggaacagatatggctgtggatgtgccacacgactgcacattatgaaaggatataagttcattatatttctttgtaaaatcattggtaccacgagaatatccattcagagcatagttttgacttcttgctgtctccccgacaactaaaaacataattaccggcttttgtttttcatttattgtgcgggatgcatccgttccagtctgacgaaactcgccaggagaaacaaaaaaatcccttacatatttaaacccactgtagatataattagtaggtattatttctttatttaatgaagagttgtttctgccaactgatgcataatccttataaaagaaaaacgcaatcgcaaatataatcaagagagatgcaaacattgatattaaacgatatgtaataccctttatccatgtctcaggataacggatatttactaacaacaatagtccacatggaagtatacccgtaaataaaaaccacagtacaacagacatattgaaatatgatgtcatttcacctgcatttgtttcaaaaatattctgcatcattgttttatcaaactgcacaccatatttcatggtggcatatgtaacaatggaactacagataaacagaatacaaaaaaaaggtttaaatatatacctgaatgagaacggtgtaaaaacaaaatttaatgcagatatcagaaagactggaagagatataataaatccaagtttcacaccatcaaggttattaataatattaaacagatgcatccagacagggatattgaacaatgtggcaaaaacaacatctatcattaacatcaagaaaagaaaattaatactgatttttttaatcatcttacccccattaattagagcctataattgtccgtatctaaaagtgatatatttttataaaacctggtaaagtgaatactgatttataccaggtcaaacttcaacttcatcatcaaaactttatgtcaataaaggcgtttatagttactgattcttttattttacaacaccactaacatctttttaataaaaaatatgttcacaatagcatacacagaaattctctaaggtattatatcatcaggaaatattattattccattcatctctggaggccccccctcgatatgaaaaacgatatcacacagaagccctgccgtgtacagataaactgtttgcagaccagtcagtgactcaggagcgacgtccgcaacaaatgtatggactgtatcacagatgctctccccgtatgactgaagacaggcatgcatgaaaatactgtcgcttccccaagaaaaggggaaattatcatctgcatgacccgaccagtgctcagtcatgaacactctgtttcagtgagcagtttccgcattaatgaatctgtcatactgctattgtatcagcaagttatccccataacaccttgatatcattctgagccagatggcataatcacagcccattgtcggatctttctgcctgattctctggataatcccgacaatatgcattgcttttctggcgatgtatagccccgggagccggaacgcttcatgacgaaaacaaacattcgtattattcagacgaaaactcactggaaaggcatcatcttttatataacaaggaaatccggctctttactgtcgttttatctttatttatcaggggcgtaagattgctcagtaccgcgttaccacaaaataaaaaaggctggcaggccatgctggatctccgttttcagcgtctgcacgggaaaaccacgctcaccacccgtcatcatgtcggtctgctcactgttcagcgtcctttttatcccgaagaagaaacctgccacctctgtctgcttcatccacccggtggtatcgtcggcggtgacgaactcatcatcaacgcaataattgactctgattgccatacgctgatcaccatgcctggtgccagtaaattttaccgcagcagcggcgcgcaggcgcaccttcagcaaaacctgacgctgtgcaataacgcaacgctggagtggttgccacaggattcgattttttttcccggcgctcacgccacgttgcataccgtgtttcatctgtcgtcctccagtacactgctggcctgggatcttctgtgccttggacgtccggtcatcggagaaaccttcagccacggaacactcgctaaccgtctggagatatgggtcgacggttctccgctgttgattgagcgtctgcacgtggccaatggagaacttacctgcgttgcccggaaaccatgggtgggaacgatgctgttctacctggggaatgaaacgcaactggaagacatacgcgaaaaactcacaccactggaaaactacgccggagccacgctcaccgatggtctactgacagttcgctttttaagtgatgataatctgcgttgccagtaggtaatgcgtgatatctggcaatttatgcggccgcaactgactgacaaatcaccggtacttccccggatctggctgacttaagagaacgctatggaactgactccaagagaaaaagacaaactattactgtttaccgctgcactgctggcagagcgtcgtctggcccgcggcctgaaacttaactatcccgaatccgtggccctgattagcgcttttataatggagggcgctcgcgacggcaaaagcgtcgctgcgctgatggaagaaggacggcatgtcctgagtcgcgagcaggtcatggaaggcataccagaaatgatccccgatatccaggtcgaagccacctttccggacggctccaagctggttaccgtccataatccgataatctgaggtaacagatgatccctggagaatataaggttaaacctggctatatagagcttaacatcggccgggctacctgcagtattatcgttgaaaatcacggagaccgaccaattcaggtcggttcccattatcacttcgcggaggttaacccggcactgaagttcgatcgccagaaggcaagaggctatcgtctcaatatcgccgccggaactgcagtgcgcttcgaaccaggccaaaagcgtgaggttgaactggtggcgctgagcggtgcccgtatcgtgcacggtttccgcggagatataatgggtgagctggaggcaaatgatgagtaatatttcacgccaggcctatgctgacatgttcggccctaccaccggtgataaaattcgtctggcagacactgagctgtggatcgaggtcgaagatgatttaactacctacggcgaagaggtcaaattcggcggcggtaaagtaatccgcgacggtatgggacaggggcaaatgctctccgccggctgcgctgatctggtgctgaccaatgccctgatcatcgattactgggggatcgttaaagccgatatcggcgtcaaagatggaaggatatttgctatcggcaaagccggtaatcctgatatacaacccaacgtcactatcccaatcggcgtatccacggaaattattgccgcagaaggcaggatcgttaccgcaggtggcgtcgatacgcatattcactggatctgcccacagcaggctgaagaagcgctgacatccggcattaccaccatgatcggtggcggtactggcccgacagcgggttctaacgccacaacctgtaccccaggaccatggtacatttatcaaatgctgcaggctgcagacagcctgccggtcaatatcgggttgctgggtaaaggcaattgctccaatccggatgcgcttcgtgagcaggtcgcggccggggttatcggcctcaaaattcacgaagactggggagctacacctgcggtaatcaactgcgcactgactgtagccgacgaaatggacgttcaggttgcgctacacagtgatacgcttaacgaatcaggattcgttgaggatactctgactgccatcggcgggcgcactatccataccttccatacagaaggtgcaggtggtggtcatgctccggatattatcaccgcctgcgcgcaccccaatattctgccttcctcaaccaatccgacgctaccctataccgtcaacactattgatgagcatctggacatgctgatggtttgccatcatcttgacccggatatcgccgaggacgtagcctttgccgaatcgcgcattcgccaggaaaccattgccgcggaagacgtcctgcacgaccttggcgcgttctccctcacctcgtccgattcgcaggccatgggacgcgtcggagaagtagtgttacgaacctggcaggtggcacaccggatgaaagttcagcgcggcccgttaccggaagaaagtggtgataacgacaacgtccgcgtgaagcgctatatcgctaaatacaccattaatccggcattaacccacggtattgctcatgaagtcggctcgattgaagtgggaaaactggcggatctggtgctctggtccccggcgttctttggcgtaaaaccggcgactatcgtcaaaggcggaatgatagccatggcgccgatgggtgatatcaacggctctatccccacaccgcagccggtgcactatcgcccaatgttcgctgcattgggcagtgcccgtcaccgctgtcgtgtgactttcctgtcgcaggcagcagcagcaaatggcgtcgctgaacagcttaacctgcacagcacaactgctgtggtaaaaggctgccgcacagtacaaaaagccgatatgcgccacaacagcctgttgcctgatataaccgtggattcacaaacctacgaagtgcgtatcaacggcgaactgataaccagtgaaccggcggacattctgccaatggcgcaacgttatttcctgttttaaggagcacaaatgctttatttgacccggcgggtggagaccccggctcagacaactgccagcgttaccctccctgttgacatgcgggtaaaaagccgtattaaagtcacccttaacgatggacgtcaggctggactgttgctgccacgcggtctgctgctgcgcgatggtgatattctcagtaacgaaaacggtgatgaattcattaaggtgatcgccgctgatgaagccgtttctgtagtgcgctgcgcagatccttttatgctcgcgaaagcctgctggcatctcggcaatcgccacgttccgctgcaaataatgcccggagagctgcgctaccatcacgatcacgtcctcgatgatatgctgcgccagtttgggctggatgttgattttgcacatcttccgtttgagccggaagccggcgcttacgccagcaagtcgcacgcccataatcacgatcaggagcacagccactgaatgccgactccggaaaaacgtctgcggctgatgcagcttgccagtaacagcctccctgttggaggctacagctggtcccagggactggagtgggcagtggaagcaggctgggtagaagatagcgccgcctttgaacactggcagcagttgcagatggaacagagtttttttgccgtcgacctgccactgcttgcccggctataccgggcctgtgaagcgggcgatcctgacagtgccgggcgctggaccgcttatctgctggcctgcagggaaacccgtgagctacgcgatgaagaacgtaaccgcggtgcagccttcaccagacttctggtcgactggcagcccgactgcccggccgaatggcgcaaactatgccagcaaagccagttaaccggtatggcatggctcggcgtacgctggcaaatatccgtttcagacctggccctgagccttggctacagctggattgaaagcgcagtgatggcgggcgtcaggctggtaccctacggccagctggctgcccagcagttaattatgcgcctgtgtgcccgctatgcggcgaacatggacagtgcccttgcaaccccggatcacgcaattggttcagcaacgccacttgcatctatcgcttccgcgcgacatgaaacccagtattcccgattattccgttcttaggagaaaataaaatgaacataatcaagcaaccgctgcgtgtcggcgtcggcggtccggtcggctcaggtaaaaccgcgcttctggaagccctctgcaaatccatgcgtgacacctggcaattagccgtagtcaccaacgacatctacaccagagaagatcaacgcattctcactgaggccggagcactggaagcggaacgcattgtcggtgtcgaaacggggggctgccctcatacagccattcgtgaagacgcatcaatgaatctggcagccgtggaagcactgagtgagaaatttggtaatctcgagctgatctttgtggaaagcggcggcgacaacctgagtgcgaccttcagccccgaactggcggaccttaccatatatgtcatagatgtggcagaaggagaaaagatcccgcgtaaaggcggtccggggatcaccaaatccgacttcctcgtgatcaataaaactgaccttgcaccatacgtgggcgcctccctcgaggtaatggagcgtgatactttacgtatgcgcggagaacgcccatgggggttcactaacctgaaaagtggtgaaggtctgcaaaacatcatcgcctttatcgaagagcagggcatgctgggtaagtaatcacaacatcctctgtatcagggccggcaggcggccccttgtttttatcagaaggaataacggaagttggcgttcaccgcgttatccacgttgtacttaccagatgccgatttttcaaactccagaccgaagcggatgttgtcgcgaatttccgcattcaggccaacattcatgagcatacgaccgtctttttcacccttgatgcgtttttcgccggatgcatcacgcagtacggtttcaccgttagccagcaggtcaaactgataaccgataccgtcgcgggcagtgaaagagataattgaaaggggtgttgcattgacagattgaatctacagctgctttttttaatatatctcgctcaaggcgagcttcatttaacgccttacgcagttgcagaatttcagattccagttcagccaccgtgcgggaaccaggagtaccgagcccttttctggcggcggtaacccattgtcctaaagtgccttcaggaagagataatcgggaagcgccttcactgatcgaaagttgattttcaagaaccgttctgacagcttcggctttgaactctttagagtaacgttgggtttttctgctcattattagctccttctgatgccattctatttcaggaaggagtgtccgttaaactcaggctacctcaggtttcactcatctgggtttttacttccagatttcgttttttgatcgctgtgcccatggctccacatcctgaaagagccagcgcagagctgaccagtgcaatcatcataacttttttggttttcatttaatgcccttcttatccgacaggtttatggaagacagagaaaccgcctttacggtatattttttcagcgggcttctcaagtatgttaaaggatacaggtaaaaacagcgggatcagatacgtcgggtaaacgtttatttcataagaagtttttaggtcagaataaaataatgggtgttgttatattatcagatgatgatttatgtgagcgcgttacggatattgcacatgaggttaaaggagagagcaagcctccgcaacggctcgcttcttatttaatggattttttcgggaagtccagtttataattatataacatattgtaatactgaaagagagtgaggttataagaacagacagttgaatctgaccgtctgaatatgtacctttatgcggaattttcacttaaagggggaaaactgttgtgaaaccgaatatccatccggaataccgtacagtagtatttcacgataccagtattgatgagtacttcaggatcggttcgacgatcaaaactgaccgggtaattgaactggatggtgtaacttacccatatgttacaattgacgtttcttctaagtcgcatccgttttatacaggtaaactgagaactgtcgcttcagaaggtaatgttgcacgctttacccagcgttttgggcgttttgttgatgcgaaaaaaggtggctgattttgccgccagggtgcgtttgacaatttaaaaacgcaccagacagagagatcctgcacctgaatataccgttagcccgtcccaccggggcgtgtgcagatgatctcgtcaccggaagattgcggacctctctgaaaaccagtacattacgcgcgggtgcctttcggctgacggctggaaggattacctgaaggccggatgtggaaaggccccgagtcaacttaaacgttaacccgaggccctgaccatctaccttcagcaagtggaaggttagcgcctctctgtaaaaggagcaagtgctatgccgcaaaaaacgatcattgtgggcatgttatgcctgaccatgttgctgaccgtctgggtgttacacgcatcaccgtgtgaattcagggtaagcttcatgtggtcggaaattgcggcgttcttgcagtgtaaaccgtaagaaaccgcagcggggacaacagtccccgctatccggttgccaaaggttcggtcgaaagtcgcacccttgcacacaaatcacaaagaaaaaacaaaagtccgcagtgtaaaaactgtgggcttttttattcgcatcccgaaagtgtggtaacagcgtgggggcaccaaaaaaagccccataaaatggggctgaagattctgtaaggaatttcacagcaatgagattcctgctttctccaaggatatacgtgtcttcaggctgaatcaatgggggcgtggctctgaatccacctgcgattaaaacttgcacaatgccgggagttgagttagaaaagtacagggcgcgatatccggcttattttgttgctgtgttttgcctcgtgctggatgtcgcgtccaccgtttttctgatgattcatatgaaatggtactttattgatttactgccattctgatttgcctttttatgttcattattgcggttgtcacttccagtttctggtgatgttttgataaaagtgaaagaataaaacgataattgcaggaaggtattgctaaaactatacatatcattatataaacaagatgaaaatgatatataccataagaccagaaaagaggttttttccagaatgatatggatgtgtattttagtgtgattgtttttgtcaggtatattgaacaaggaagggccaggccactgagtatcagaaataagtcaacttttatcgatgcttctgttggtgtgtcatatatcagatgcaatatggatattataatggggcacattccccacaggatatttttgaaatagaatttccggttcatatgtttatgctcttttgttttatctcgggaattgtctctttttttttattcctgaacattttcgttgtttaataaccatggggtattatgattatcctttatttttgatatgtaattgtcaatagtggatttcgtttcattattgtggttatagtaatcatgaagagtgcaaaacacatcatcttttattgtggcgattaatggggggtgggtgaggttaaaatataaagaacgattgcttagtgtcctgaaatgaattttttcgccaatgaccagatcggtgtttattatattgtagcctatttcaattatattgtttgatggcatgtgtaatacatatatgggatatttgttgtgtttttctattgaataataaataaaatcaggcacagacgtctgttttagttttttttgcatctttcttatatgtcgtgacattaatatcattttcgagagaatgaataagagtctaaaaaagagattaaatactatattcagtactatcagagtaacaaacaggccaactccccatagttctgaaaatatattgtcattgtaaatatactggaatgtatatccggctgataaaaatgccaatatatataacgctatgtctgttttgtttaggttttttattagatcggttattattgattttaagaataagatggtaataagaccagtgataacccagaaaaaaataacggaaaattccataattatacctttatcgtgtttctggggtggtaatctatcattgtgctgatatgtgtgtaaatacatgcattatctgtttcttatattctttttatgaagttactgattaatttatattagaacatcacattcataatgaaatcaacatgttcatatggttgggttgacggcagatttccctttttgttaacctgtatttgcattaactgtcgcttttgcgaccagccaatgttccagcagtctgagagggacgccttcgggtgactgccagccaatgtttcagcaatctgagagaaacgccttcgggtgattgcaatatcctcgtagcctgaaagaggatgcctttatggtggtacatccgtttagcctctgggaacggatatcactacggtgattgaggtacgttgatttttccttcggattaccgtggtgcttccggacaaccggactactgtgtattcccggcagactggcataaaaacgcctttaaaatctgcgtcttaagatattttctgactttccgcatgcgcttcttatgactgtgcgcacggcataagaccatttgaaatttggtcgcttgcgtgtgcatgtggagtttgaagctgtgcgggcgtcactttcgtcagcgttaaagctgacaaagtgacgctcgcacgtctactcaacgaacccgcataaactggctctttacgagatgttttttaacatttgaagaagtgaccagacgtgaacgtttttttcaacctcattctgtatcgtactggcgcttctccggactgacttactgaaagcttcgtaccaacagaatcgcattgttttttaaggagttttatgtagtgagataccgaatcggcgatatgtctgacaggcagatatatcgggggcgacctttaaaggtacagttaattctgcggtcggttagccaaaccgacttgacaccccgctaaacctgaactgattgcgttaccctgacgcacaggtactcactcaccgaaggaacgtaactacaaaccgtgtcgtcagtaatattccggcgaactcatattgacgcgtttttcgggcgcatcatcagcgatgcatacgaatgatcgcagtctgacgatggttgatttattctgttgcgccggggcgaccgccaggctggtatcggaggcgggttctgaagaactgaggtattgttccggcgaactcatattgacgcatttttcaggcgagccactggcagcgcatacgattgatcaccgtctgacgatggttgatttattttgttgcacaggggcgaccgccaggctggtatcggaggcgggttctgaagaactgagtcgggtaattgcgtcaggtcgcgaagtactgacacgggtactgatggcaggtgatgaagtacagccccgggaatggctccgggctgattcaggttctgactcactgtcagcccgcgtggtcgctgctctggctcatttcctgtcgtcaggcgttcaactcccgactgcgggttatggcccgctgcacgaacacctgatggcaggtatcactcacccggagaaggtaaatccctcaaggggcagcaactcttccagtcggtcttccggccactccggtagacgcgtcagaacgtctgtcagccaggcatgcggctccagaccattacgttttgccgtttccagaaggctcattatctgtgccgcgcggttcccggccatcagtgaaccggcgaataaccatgctttccgccccatgaccaccgggcggatagcacgctcgcagatattgttgtccaggggcacggctccgtcactcaggaagcagctcagttcatcgcgccggttcaggatataattaatcgctttgtttagtggtccgtcgggcggacagcacggctcctgctcttcaggccaggcaaacaggtcattcactatcggccgggaataccgttgtcgccattgccgtattttttccacaggacgttcacggatgaacttctcaatgcgataaagacccgcgatttttctcagcgccatggctgcacggggctccctgctggccttatacagatttgcgaaaccgcgccttgcgtggctccagcaacaggcagatgtaataccggggtcattatccgccagagatttgtacacgctgtatccgtcactcaccagcgtaccgccacaccagccctgcagccaggcctcaggatatctgagggcccgtccggtctgcgagtcaaaacagacgaccggcggaccgcttctttctcgtaagcgtaaactgaccgccgtatgtagccattaagccagtattggtaacgtaggtgcccaccttttcaactagtggacacctgttatggaacagaaaatattatcctcagaaccccgcagatcattttcaaatgagtttaaacttcaaatggttaaactggcttcacaaccaggagcctctgttgcccgtattgcccgggaacacgatatcaatgataacctcctgttcaaatggctcaggctctggcagaacgaaaggcgtatatcgcggcgtcttccggtaacaacctcttctggcgctggcgttgaattattacctgttgagataacgcctgatgagcagaaagagcctatggcggctcttactccgcttttatccactccttcacaaagcacagtcagtgccagttcctgtaaagttgagttccgccacggtaacatgacgctggaaaatccttcaccagagctgctcacggtgttgatccgtgaactgaccgggaggggacgatgatctcgctcccatcaggcactcgaatctggctggttgccggcgttactgatatgcgtaaatccttcaacggtctgggagaacaggtacaacatgtgctggatgagaaccccttctccggtcacctgtttatctttcgcggccgacggggtgacacgattaaaattctgtgggctgatgctgatggtctgtgcctgttcaccaaacgtctggaggaaggccagtttatctggcctgcggtgcgtgacggtaaggtatccattacccgctcgcagctggcaatgctcctcgataaactggactggcgtcagcccaaaacatcccgccttaatgcactgacaatgttgtaaaaatgtcatggccggattataaaaacggtcatgagtcggaaatacctcattcgtatcactgagctggaaaggctgctctctgagcaggctgaagccctccgtcagaaagatcagcaactgagtctggttgaagagacggaggccttcctgcgctctgcactggcacgtgccgaggaaaagatcgaagaggaggagcgggaaatagaacatctgagggcccagatagaaaaactgcgccggatgttgttcggtacccgttctgaaaaactgcagcgtgaggttgaacaggctgaggcccaactgaaacaacgcgaacaggaaagcgatcgttacagtgggcgtgaggatgacccgcaggttccccgccagttgcgacagtcacgtcatcgtcgtccgttaccggcacatcttccccgtgaaatacaccgtctggagcctgaagaaagttgttgcccggagtgtggcagtgagctggattatctgggggaagtcagtgctgagcagctggaactggtgagtagcgccctgaaagtgatccgcactgttcgggtaaaaaaagcctgtacaaaatgtgactgtatagttgaagcgccagcgccgtcccgcccgatagagcgcggcatcgcgggctccggattacttgcccgcgtgttaacgggaaaatactgcgaacacctgccactgtatcgtcagagtgaaatctttgcccgccagggcatcgaactgagccgggcattactctccaactgggttgacgcatgttgtcagttaatgactctgctgaatgataccctgtaccgttacgtgatgaacacccgcaaggttcacactgacgacacaccagtaaaagtgctggcaccgggcagaaaaaaggcaaaaacaggacgcatctggacgtatgtccgggatgaccggaatgcgggctcatcagagccaccggcggtctggttcgcctactcaccagacaggcagggaaaacatccggtacaacaccttcgtcccttccggggtatcctgcaggcggatgcgttcagcggttacgatcggctgttcagtgcagaacgtgaaggtggtgcactgacagaagttgcgtgctgggcccatgcccggcgaaaaatccacgatgtatacatcagcagcaaaagtgcgacggcagaagaagccctgaagcgaatcagtgaactgtacgccatcgaggatgaaatacggggattaccggagtcagagcgtcttgccgtcaggcagcagcgaagcaaagtgttactgacgtcactgcatgaatggatggtggagaagaatggtacgctgtcgaaaaaatccagactgggcgaagcgtgcagctatgtactgaatcagtgggatgccctctgttattacagtgatgacggtctggcggaggcggataataatgctgcggaaagagcgcttcgtgcagtctgtctcggaaagaaaaactttatgttctttggcagcgatcacggcggcgagcgtggagcactgttgtacgggctgatcggcacctgccgtctgaacggtatcgatccggaagcgtatctgcgccatatcctgagcgtactgccagaatggccttccaaccgagttgatgaactcctgccatggaacgtagtactcaccaataaataagcgtcaatacggtgctccgttgacgcttactctttctccgctgacgtaagcccacagccagccggagcaggatttaccgcctttccgggtatcaaggagcctcagggacgtttcatctgcatgaataacatcccgtgtcagaagctcgtggcgtaacaattttgccagcggggccagtgcagcgccagcaacaccgaccatatccgccattgtactgacggggagctccacccccattcgggagaaaatgtgctgctggcgatacaggggcagatggtcggtatatttgctgatgacaacctgtgcgatgaccgatggctcaacagcacttttcggaaggatatgtgccggcatttttccgctgaacactttctcacagcagggacagctgtactgcgggcggatatagcggttgaccacgacctgtgccggaatatattccagcttctcgctgacttcatcgcgaatgaagtgcaggggggcatcacagtcaggacaacgttcctcagctggcgggataaccttttcagcacggggaagaggtgaaggcaagggcttacgaacaggacgtgttgttgttttttcttcgtccccggtctgaggaagcagtttgtccagatgcgccgagatttctgcgatatccgcgtcaacatcctcttcgaacagggaacgctgcatcccggccagcgattcgcattttttaccgaaacgctgctggcgtgcgagcttcatctgctcttccaggatgcggatacggttctgaagttctgcattctcagccatgactttttgcaccatggcaattgccagagcgcgaagctgttcagggtcactggtggtactgagaagcgagatatccatgcggtggattatatgacatcacgcatggatattcattatatttcattgagttattgcgttgctctgagcatcttcgggttcttactggtatacccattttgccaggtcatgccctttcacctgttgccagtcaaccccaaagaccagccagtgaaactcatcctgtgtgagatgccatgtggcatcacctttccggggccagcggaagcttccccggtgcagtcgtcgggtacacagccatacgccatgtttgtcccaccggagaacttttatgcgggagcggactttattggtgaagacaaaagcagcaccgtcatgccatgcagcgttaagttcgttctggacgtactgtgtcagtgtgtcgataccccggcgcatatcgacgggttttacgaccaggaatacgttatcaggcgtcagcatggcgaagagcccggaaaacatcggttaactgagaaggctggcagcacatccggataccaccgggcaggaagagagtgacaggctcatccgacaatggtctgccatcagtcattccggaagagccagatactgaaacaggaataatttctggtgctctggctcgtttttcggcttttgcgacatcctgcggccactggcgcagggatttaaacggaatgtcgtaaagttcacagtactgttcacgggtaaggccgctggcgcgccatgcggcaacgtgatgttttttctgatcaagcgtccatcggggttttgacattgattatctccggtaagttggtgaatggatgtcggtaatgctaactgactgaagatccctgtgaagatgacttccccgtaacgacaccaggatgccaatcaatgagcggaagcatgccaaatcgtgatcgattgtgatgccaaacagtgatcggaaatggatgccaaaccatgatcgattcagatgccattttgcatcacgccaatacagaggtgaaatatgacaaaaccggagttttcaccccggtctgagatttagcgtcaggactttttagcgctgtattcttttatcagttcatcaacggagtgcagagccagcttctctaccgcttcacttcgggtcgagtcactcagcgcagccagacggtcaatttttcttagaatccgcatgcgtagcgataatgacacggctgtttttttatccttatcgagtacgaccttccctgtggactcaccggttttcagttcagcattctgtgcgagcgcttcattcatccggcggagggtctttttatccaactggcccggattaacgagatgataggaatgacctgccttgctgtatttgatctccgcagaatatgactcgcgtagctctttgagggcccgggttaatgtcggctcagagcattccagactggttataatgtcggcagcggaaacgggcttgccggtgcccagtaagttggcaagcttaaaaatccgggcctgtctggtatttaattgcatcgtaagatttagcctgcttaaagggttagtggttcaataggctgaaaaatgaaggtactgctcatctttcgaataaccggttgatcgcctaacgcttcaaccggatcaatgtgttttatgcctgcaaaatttactgacgacatctggctgcgagtgcatttgcaggacaggatatactcatcctccagatagccggtccgcttactgacccgttgcgtaaagcctgacacaatcacgttgtcgaaaggtagcgtatgtaaaacgataccgaccaggcggaacaagcagccatggacgtggtgggcatagttttcgcgtacggctttttgcgtcatggctttttccgtcagctccgttccccgggcattaacgccgtaaatcttatcagggaaatcttcaatctcagctaaatcaacgtccagcaggactgctgatagctccggctttacttcaaatgcaacaagcgtttcacgcggccattcagtttctgccagcacacccgccaggtatgattcgaaaaacgcggcgtctgtccggaactgctgccgggcatctgcctgagccgtggcgagccgtttttcatgttcttcagcttcaaacttccagtttgcatactgttcggcccaggccgtccgttgttgctggtaccggtgctgtcgaagggtattctcacgctccacatcaatcagctcctgctgccaccggcgaagattttcggcgtggcgctcagctttagctgattccgattcaaaccatttacccaaaaaactaatgccttcgctctcggcaggcttttccggcaatacaaggtagtctggcttttctggacgcaccggtgccggaacctgaaaaggcgacgttctgttatgcaggtatactgcttccagctctgcccagctgatgcctgtttttggatccggcgtcagctcgtgaatattacggattgcggttaccgctgacatgagttcagcggctttctgctcaagcgcctgtctgagccccgggtcggttgccgtccggttttcacctctggaacgcgcggcccggtcaagccgggtacggtaactcagcccggtaccgggcaagcccagattggcataggtcccccggctaccaaaagaaacggaagcacctctcggcccgacactcaggctcggtgcaccgttactcaggttgaggcgaacgccaggaataatgttgatcgactttctgaacctgaaccccattatgatttccttaatgatgctgggtcacggtaagtaatctgattccatcagcgctttgctcgttctgtaacccataaaaacgagccctgtccagaatgccagccgcccagcggcgatgtgtggcgggttcacacattgctccctgcgacttaaacacggcctgggtagagttcaggatccgcagagcgtcagaatgctcaccctgagtgaccatcagcgcgttttgaatgacctctatctgacccgggtgaatggccgttttcccaacaagcccgtgtgccatatcaagagccagctctctggccataacggcatgatcgtcaatatgctcacatacaggcgcggtcagggcaaaatcacgcgggccgaagaccgaaacgagcattttgatgacgtagcccatcgggctgtcatacagcgtcaggtcccggggacggcgaagcgacacaacgttcataagatcgttgccgccgattcgaagcgcaataatgcggtcgtggcagggatgttcctccagacgggtagccagctcgcgcatctgaaccacgtcaaagacatcttctgtttccagcgttggcatcatgcacaggtgagtcccgaccatgatatcccaccattcagctaacgaactgagggtaaatttaggcagcacaaacccgtcgacagcggaaagatcataatgcgcttttaaccatctgcccatttcggcatgccgggggcgaatgaacaccagaggccagtcatttttacccaggctactcatgctgttactgagctcgtgcagcaggtgctccagatttttgagggcgacggggatgtctgcttcactgacagcatcctccaggcaaatcaccagagagcgcaagcccgggattttcccgtgcaggacggcatcagcaatatcttcccgtgttgcaggcatgtatagcgtggctcccagattccagggagaaagacgatttttcatcagagtaccttcttgataatggttacagcccgatactggccgagggttccccccatttctgtaacaactattcccttttcacgagcaagccctacaagcaaggcaacgtccgggtcgtcaatagaacgcacaaatacatggtccggtacccgacgtaatacagcccgggttgcttcagcaataccgggtttaatacgattgacgctgtccactttaaattcatcggccaggaacgcgataacgtcgcgacttgtctgccataagacccgggctgattccgtattccagctcaggggagcgagggatgacggtgttaacttcttacggaaatgagcgacggtatcggcaagcatccggctgcattcgaattcactgagatgctcgcaaaccatgcacccgtgtaatccttcagaggaccatactgaccgggagatcaggcctgataccggcgcccccatgatgccaaaaggaatgagccagtcatcatcactggctgcaagccaggagcagccacagggatcggccaggacaaccagtcgcggctgctcaggatagcccgggcgatctttcagtgcgcgtacaagctctccggtaattgcgcctttacctgtccatccgtcaacaaagacaataccgctggtaccatgccgctcttcaatgacgtcgagggctgcaccgtcaattccacgatcccggataatgctgataccgtaatgccatgaggttttccccatgtcacgcagggcctggtgcagcataacgccgagcggaacgccagccctgacaagactggccagtacaatgggctcatcaccgaagcgttcggccagagcaatagcgagctgtgtgacttcttttgcaagcctctctgcgccccgatccagcgcccggtgaaacaaatcaagatgccattgtgtaggcgctggctcctggctgagcatgtccgaataatgtttcttcccggactgaatcagttcttcttttttctcaaccggcgtcatctcaatgacaaccggctttagcagaaattccacgtcaccgggctggtatgagccggtaaatgtttcatgtggctgcattttaattttctccaaaaattcgctgtgaaatggcatctgcaaactgactctgacgcgggatgccaaaccagctgcacagtttcataaaacgatgatcgctcaggctgtcgcccaaaccaattacggggaaaactcctcgttcagcccgaagtttttcaagcagccagctgactgccagccctttctcaaccggggtgggaagccaggccacgttattactgttgcggtggatgtagaagccctcggtcggaaacaccgtttctatctcatctgcaatggcattgagctcgtcaaggcgggtgctgtcgcggtgtttcatcaccatataaaccgccgtttcaccgtattcgaagttcagccttgcccaggcattgattccttttgcgtccatcatttcagtgatcagacgctgcatcgatgtcagcttttcctggtagggagccagctggccgagcatatgggccttccactcctcgtcgggtttgccttcaggcgtgagaatgacggccccgtgcgttgtgattgcccaggagtggaaagggatccgtacgcggctgatttcttcagttccccgtgcggtaacgggtatgagttcagcctgctccaggagccagtccaccaacatggactgttcttccgtcataaagcttcgtggattcagggtgcgatcaacggcaccggtacggaatggctccagggccagctcgtccaccattttacgacgggtctgaaagagcgtgtcgtcaaggtcgctcagaacaacgggtttattcataggtaacaatctccacgacgggcgcaacctcagccagcgctttaagaagctgcgtgtcaatactttctgcgggtgtctcagtacacacaagaatgcggtcaaactgctggtgggcgacgttatagacaaaattggggatgcccagcccgtagttatccgtaaaggaaatggcggactcaatggcataaccaacggcgacaggggagcgggtggtcgatccataaaatgcctgtgctccggcagcttcgagccgttcagcaagcaggaacggctcccagacgaattccccggtcccgagaaccagaatacgttcccccttgtggacggagacctcatggccgagatcggccgcaggtgcgagcatccccagtcggccccatgactgtttcccctggatgtcccattctcctcgtgaagttacgttgactttcggcatgtccgggacaggtgcatcaggtaatggggtccatccccactgaccgcttacaagcgaaaccgaagtgacgggcaagggggtgcgctccgacagggcattgccactccagtcggtcagcgttacggcgataacctgttcaatatgttgaagcttgccggtattacgcagggcagaaagcaggttaataaaggtattaccggtggttgcctcgtcatcaatcaaaaccagcgttcgtgcgttggtaacacgacgtcttttctcttcatcatctggcagatagatcagatgatcggtggcgtggctgtgttcttccttgaactcgcaaagcaacgtgccatcaaccgggtgacgggtagaggtcagatagacagattcacgatgctggtggcgcacttcatcaaatacaccggccccaagcccaacggcggtttcagccataccgataaacagtacgggtcctgtcagtgtcgaggggaactggctggcaagctgtctgtaggcctgccgcatgactgagggtggcacgggaatgtgcctgccgagtactttgctgacaaacagaaaggcgcgtttcgggttacgtctttcagcgatgtcaaacaggtcatcgagcgaaacttcaccctggtcacgggttacctgaatcgtaccgcatgagagggtacggcgataaatcatatcttcgaggatatcagacataaatacgccttaattcagaaggttagagagtgattccgggtatgcaattacatccgtaatggatctcaccgcaaccggagaaaaggtgtttttagcgctctggcgtaccatatcttcagacatcagaccgagcttaaaggcagcaaataacccaggaaggttcacaccgctgtgaagggtataacccaccccccctgacggacgcatgttggtttcaagcagcaccgggttgccattcacatcgtttcgcgtctgaacattcaccagcccgtcggccttcataacacgggcgcagtcacacgccagttcccaggcgcttccttcgtttaccagatactggatagccccttccttacggcgtcccacggctgcgagtatttcgcccttatccgcgaggatatcgacggaaaattccgggcctggcaggtacggcatcaaaacaaggggtttaaacgactcagcagctgatgctgctgcaatatactgttgcggactgaccagacgatgttcgggatgattaaagacggccataggcgaagcactgtcatcaaagcgccagaatcccatgccatagatacccgtcaccggcttcacgcataccgggctgtcagtgaacggcggggccgcgaggtgtgtctttaattctgccagcgtattcacccgccaggatggtacgaccgggagacccttttgctccataaactgagcaaaagtaactttttcgtcagccagagttaaccagtcgacgcccgttgcaccggtagtaagggtggcaccggtcggttcaatggctgaacggtgttcttcaaaccactggctgttacggccagtatgaatatggtggatgccgtaggtctgaatggtttcctggataaactgaagacgtttttgaggatcttcaggttcagtcaaagaataatcggcaacggaaaggatttcatttctttcgttacggtgggaggcaaaaacggtaatggcaaaattatttttttgtgcaaatgattttaccccctgaataatatctcgctgggaggataaaccttccataaaccaaattttcttgttcattttttttaattatccggaacgccatgcaaatttatgattgagaagtgagtctatgagtgtctaagctacatgtcaatcataatatgattaataactcctgtggttatggagtgcgtcagtgttttttggattccttataacacattgatatttaaattaaaaatagaaaaactaacaccctgaaaaggatttctttttgtgtttttacagaaaaccacaaaaatttcccttgtcagagaacttcatcatgatatgattttcttcgtcagttactaaatatacctttgattgtctcggtcattaccattttaaggaataaaacatggtttcattagttaagaaccagacggtatcactcagcaaagaatcatctgcattaagccagcttcatttcggtctcggttgggatccggttaagaaaaaaggtcttcttggaggattgtttggaggcaacgactcaatcgatctcgatgctggctgtgtattaatggacagcacaggtaaaacaattgacaccatctggttccgcaaactgaaatccacctgcggcgctgttgtgcacagtggcgataacctgaccggtgagggtgacggtgacgatgaagtgattaaggtcaacctctcccgcctgcctgcaaacgttgaatacctggcgtttacggtaaacagcttccgtggtcagtcgttcaatgacgtcgaaaacgctttctgccgcgttgtcgatcaaaccggcaaagagctggctcgctacaagctgactgagcagggctcacataccgggatcgttatttcttcgctgcgccgtaataacggcaactgggactttaccgcccttggccatgcctgtcgcggccgcacaattgacgatatgcactccgatatcgtttcagcggttattcgctaatgaacctgacgccggggggcaatgcccccgttccagcccaggagttgcgggtccggatcacctcgggcggccaggtggatgcttcggcgtttcgcctgtatgccgacgggaaggtgcagggtgatgcggacatggtgttttatggtcagccacgtaacgatgatggtaccgtcagcctggtcagtgaaggccagtactcaacctttactgtcgcgctcaaccggctgaaacctgatgtccagaaaattgcgttcaccgtgacctgtgacggtgggcagacggtgtccggtcttcgtaatctttccatcgacgtggagcaaggggctaccggcctggttagcggcagtgtcgaactgagcggccgtcaggaagcagccttaattctgggggaattttaccgtcgtaataatgactggaaattccgcttcgttgcgcaggggttcaacggtggacttaaaccgctggcagagcatttcggcgtaaatattgccgacgaaccggctcccgcagccccaactcctccggttgtaacccctccgccagttgagacaaaaatcagcctgagcaaggtatcgctgacaaaagagaagcctgcaatcagcctgaccaaacgggataacttcggtgaaatccggatcaacctgaactggcaccggggcagtagcaaatcaggctttgcaggtatgttcggctccaaaggaatcgacctggatctgggggcctttgttgagcttcaggacgggtataaatcggtcattcaggcgctcggtaatgcattcggtgattatcgcgatgaaccgtatgttcagctcaagggcgatgaccggacgggtgatgtatcagacggcgagtggctgcatatcaatggacgtgaatggaagcatatccgcgaagtgctgatttacgcctttatttatgaaggtgttcccagctgggacaagactgatggtgtagtcaccattcatgtgccggatcaaccgcccattgagacccgcctgaccgaaggtgagaaccgtcgcacattgtgcgccattgccagactcgtaaacgaaaacggcgcaattaaagtcgagcgaattaaccagtacttcaaaggccaggacgaaatggaccgggcatttggctggggatttcgctggagcgccggttctaaataacacagcaacaaaggaaacaggtatgagctttttcgacaaagttaaaggtgccattaactcaggccgtgacgaactgacccgccaggttggccgtttcaaaaacaaaaaattcatgcagggcaccgttgctgtatgtgcccgtattgccgtatcgagtgacggcgtaagttcggaagaaaagcagaaaatgatgggctttctgcgctcttcagaagagctgaaggtcttcgataccaatgaggtgattgagttcttcaataaactggtttcaagcttcgatttcgatgttgaaattggcaagggcgaaaccatgaaatacatcctggcgctgaaagatcagcctgaggccgctcagctggccttacgtgttggtattgccgttgcgaaaagtgacggtaacttcgatcaggacgagaaactggcctcccgcgagatcgctatcgcgttgggcttcgacccggctgaatttggcctctgatccacatccctaagggtaaaatatggtttccacacacatcggcttcccgactgaaacggtcattgtttttattgcgctttcagtcggtgccatctttattgacctgtttatgcaccgtgatgacaagccaatctcgctgaagagtgctgcgctctggtccgtattctgggttgtggttgcgatggcatttgccggtttcctctatatccaccacggtgctgaggttgccagtctgtttgtcacgggttatgcgctggagaaagtgctgtcggtcgataacctgttcgtcatgatggcaatcttctcctggttcgccgttccggatcgttatcgccaccgtgttctctactgggggatcattggtgccatcgtcttcaggggcatctttgtcgccatcggtacgagcctgctgagtctggggccgtacgttgaagttgtcttcgctattatcgttgcctggacggcggtcatgatgcttaaaagcggtgatgacgatgatgaaattgaggattactcccagcatctggcttaccgtatggttaaacgcttcttccctatctggccgaagctcagagggcatgccttcctacttaaccagaaggaagtggatgctgaactggcgaaaccagaaaacagcgatgtcaccattggccgtggtaaaaaagcggcgctgtatgcgaccccgctgttcctgtgtgtggctgtggttgaactctcggacgtaatgttcgcgtttgactcggtaccggcaatcattgccgtcagtcgtgaaccgcttatcgtctatagtgccatgatgtttgctatcctgggtctgcgtactctgtattttgtccttgaggcactgaaacagtacctggttcatctggagaaggccgttatcgtgctgctgttcttcatcgcggcaaaactcggcctgaatgcgaccgatcacatctggcatcatggttacagcatcgcggcaacaaccagcctgtatgttgtactgggtgtactggcgctgggcattctcgcaagcgtcatgttcccgggcaaacctgaatctgaggaaaaggggagttaatccccttaagtgttaacctgaacaattactaatcgaagaggttattttatgagtgtttctctttccaaaggcgggaacgtctccctgagtaaagcagctccgtcaatgaaaaatgtcctggtgggccttggctgggatgcgcgttcaacagacggtcaggactttgacctggatgcttcagcattcctgctggcctcaaacggcaaagtgcgcggcgattcagatttcatcttctataacaacctgacgtcatccgacggttccgtaacgcacaccggcgataaccgcaccggtgagggcgatggtgatgatgaatcgctgaaaattaaactggacgccgtcccgtctgaagttgacaagatcatcttcgttgtgaccatccacgatgctcaggctcgtcgccagagctttggtcaggtatccggtgcgtttattcgtctggttaatgacgataaccagactgaagtcgctcgctacgatctgaccgaagatgcgtccactgagactgccatgctgttcggcgagctgtatcgccacaatggtgagtggaaattccgcgcagtaggccagggttatgctggtggtctggcatctgtatgtgctcagtacggcattaacgcgtcctgatcgaaaagtaacttttcatatctggggctgttaattcagcctcattcaactgtttgcaggagctaaaaatggcagtttctctcgtaaaaggcggcaacgtatctctgaccaaagaagcaccaaccatgaatgtcgctatggttggcctgggctgggatgcccgtgtaaccgatggtcagggttttgatctggacgcttccgtattcgcagtaggtgaagacggtaaagtactgtcagatgcccatttcattttcttcaataataaaaccagccctgatggcgcagtagagcaccagggcgacaaccgtaccggtgaaggcgacggcgacgatgagcaggtcaaaatcgatctgaccaaagtctcagcagacatcaaaaaactggtatttgccgttaccatctatgatgcagaagcgcgtaaacaaaacttcggcatggtgagcaacagcttcatgcgcgtttacaacaacgacaacgggacggaaattgcccgtttcgatctgtctgaagacgcctcaaccgaaaccgcaatggtcttcggtgaactgtatcgccatggtactgagtggaagtttaaagctgttggccagggttttgccggtggtctgtcagcgcttgcttcccagcacggcgtcaatgtctaaaagacgctgagtctgaccccggcaatgccggggttttttttgggtatcgatccgctatcaacgggtgaatatgggaaaggggggggcagaaagcagagctatgttaattctggcatgaaccttttatgcaggccccgggtttatctgtggttgctggttaaagccagtattccgtgtctgatatcaacagcatgcccttcggatatatgttacttttgcgacttatgaaggaacgggccctggaaaataagatacccggtcaatgaaaattcaaattcaacaggtatagaaacttcagcgttatgaaaaatggtgtcataccatatttacgcctcaccgaatatccagcgtccagaactaagcctagggaacatatataaacgctgcgcattaataataatcaaaaatcaggagagttaatatgaatttacaatccggacaaaacataccccttcagcaatctacgatcaggctgaatcttcagtaccctgccaaatccggctttaaaggcgaacccgatacctgcctgttcatgcttaatgctcagggaaaggtcagtggcgattctgactttatcttttataataatttgtcttctcctgagggggcagtcaggctcgttaccggttcgcagcaggccagcattgagatagcactggatcgtgttccggcgaacgtcagtaaaattgcgatcaccgttgtcattgatggtgaagataccatcagttgaggctgtacgcttactgacaaaatggcgattgagaaggtgcaattgacttatttggatttggtcgtggcgaggtggtgaccctgcattctgctaaccgggttatgagtcaggagtcagcgatagacaaagggacttatctgaccgggcccctggaaaaatggcgggagagaatgataccttcctgctgacgagacaggactttgagatgacgagcgatagtgcggcagtgatgtacagcctgatcggtagctgcaaaacttaacggaatcgagccggaaacgtggctacgccacgtgatcagtgtaatcaacacctggcctgccaaccgcatgaaagagttgttgccctggaacgtcactctctctgtaaactaatttttaccccacgtccttcacggtgcgcttacactctggacaagtatgtaaatgataagttaaaaataatccgtgcatttcctgtgacgatattagttgttggtaacgaaatctcattagcggatcggaaatgcacttaacctaatacgttgccactgttccgccaggagttgcagtggcaacgtattctaccgtcagtgatagcgttttgttattatcagaactgatagttcagcgacatccagtaatttcgctcaggtatcacatatcctgttgttgatgatcccgtctggaagtaatcaccggcatacagcgtactcttaccggcactgtacaggctcacgtcactgtaatccttgttgagcaggttattcaccgcagcattcagcgtcagggcatccgtcatcttccacgacagacctgcatccaccaccgtccaggctttcaggtattctcctttctcatcatacactttcttctgtacagcgctcagtgacgaataattctgggtgaaacgtggtgttttcccgcgataacgggcacccagccatgatgccacctcttcggtgatctgccagttcagtttcgcattcaccatgtgttcaggggtataactcagcggcgcacctttgttatcaccatcacgttgttcacttcgggtccaggtgtaattcagtgacagcgtgacatcctctgaccacagcggcaatgtgccggcaaattccacaccgtgcaaccgggcctttccgctgtttacatagctattggtgttatcatttatggaataagagacaatcttgttggagaagtcagtcataaaacctgtgacattggcattcagaccggcggggttatcgtaatacaccccagcctcataactgacgctctcttccggcttcaggtcggggttaccaagtagatttgtttttccctgcccggacacaccactaatccctttatgtagctgccccattctgggtgccttatatcccgtggtcacaccgcctttcagcgtccaggcatctgccacatcccagaccagatatgcacgcggactgaagtgtcccccgaattgctcatgatgttcatagcggctgcccgcagtcagcgcaagtgcatccgtgagatgccactcatcctcagcaaataccgaccagcttttctgccggaaagtttcacctgtgctggcaaggacaactccgtctttcatggacgagctctgaaactcgccccccaccgtaaccagatgagattctcccagaggggtaagcagtaatgaattcaggataaggttcgattccttaagctcccgcggctgaccggcaagcccccatttgtcgcgcttcagtacactgcgtacaagctcacgacctttattttctgtctcgttccagttcagatacgatttccatgttccgaaggtgaaagtatgatcatagccagctgaaattttgtttcgctcatagcgcagggtccggtcatatccccccgtcagactccccagttgcccatcccggttatcataacgctgccgggtggtatccatatcaaaccagagcacatcctgctccgacgccttccagtcaagacgtgcaccaagattataattctgtgactccgtgggataaggaatacgcgtggctgctgtatcgctcagtgatgtgaccgatgaaccctgacgctgttgtgtgctaccgcgtacctgcaggctgacagaatcatccacaaggggaccactgctccagaaattaaactggctgctgttaccccatttgttgctttcctgcagattcagccctgcattgacggaagagagccatttgtctgcattctttctggtaatgatattcaccacaccgcccatcgcatcagagccatacagtgtggacatcggccccctgataacctcaatacgctcaatggcggccagagggggcatgaacccggtattcatggcagaaaaaccgttgggagtcacgtcactgcttccgccctgacgaacaccatcaatcagtatcagcgtgtaactggctggcattcctcggatgctgatttccagccctccggttttacccgtaccactttcaacatccacaccctctactgatctcagagcctccgccagatcgtggtactggctggactgcaattcctcctggctaatcacagaaacactggcggctgcgttagtcagctttttctcatagccggatgccgagacaatcatcacatcctctgcagcagctatgctgctggctgaaaatccgagacagggaatgactacggaagccagagtggttattcgcatattactaatctccgatcatgttaaccggcaagacaatacacaaatacaaacaataatgagaataatttatatttgccttttacaaaaaataaagattattgacaaaaccaaatataaataacgactgcctcggcatgccagttaacagctatccgtatggcgtgttcggttttgcgaataaaaaatggttactgtagaagcggatttccaccacatgtcaaccatgaatggtcagtgatgcgagacgactgggatgatttggtcgatgacttcttccggcgaatactgatagaaacattgaaatattgtaagagaaagcgttcaaaattctgtggcacgtgaaaaattctacagcgtcatcaccttattcagtcgaccttcaaaataaacgtttaacagagacaatcaccatttggattgtccgctgaggaggcgaacaatttcctagacagctttatcatgtcagcccacattgttggcgctggcaatactaaggacaaacgatggggaagtagctttttagcgttattttcgggagtaaaaaacgtggtatctttccgtatgtcagttgtatcttgctggtattcgtagtcgtgataaggcatacaacgatatttatcttgacgttagtgaagaataagttgttttgtgatctatgttaatctgggattacaatccgggcttgatacatcgcatcacgacttttattctcttcagaatagaatatgttactccccgctttacaggctcaggatttgaattacaaattatacttttaagtgaacaataaccaagggtatttcttatttcctgaaaccaggcttggcccatttcgggatgagtttgaaaaaactcttgacgcatacgatagtgatgaaataaacgaaacaaattaccgtcaacaaactcaggcgtcttgcctgacatgctcctgacatcattgatattcacgctcatctggcatatgcatttgcgctctttatgctgcaattctggcgaatgttcatttacagcgtcatcaggatgccgttatactcattgataaaatactaacatataaccctgagaataatcagggaacacgctggttactgggggcggaattgttacgtgctggcaagcatggcagggctctgtacgtattgacaggacatgtcaatgaatttcccccctactggtacgagcttgctcttttacattttatgaatgaggcatatattaatgctgcaacggcatttcgatatggatttttaacaagtatatattgttgaaatgctttgttagaatctttatccattccctagggctgtatagtatgatttttcaggtatttctgaatactgccaaatattattgcaaaatattctctaaattatgaattaaatatccataagcattattgcctgggaactggacatataattactcttctgtgctaaaggaacgttctgaaatgtttaagtatgcagagatgttgatggcggaagaagatgataaagtatgtgaacttatttttaaacaacaagataatttgattttaaaaataaatgttagatttcccagaataattataaagaaataccgaacattacaaggtaaagtcgtatggctatggatattgccatttgttattgaatggttaattgtgtgtactttgggtgtaaacagttagcttggtaaaagtaaatatcctgattgttgtttgttaaggagtgagatgcctgtgcgtctggtgtctattatattcccaatattattggcgctattcttgctggcgtaggcatcgccatactatgaatattgtgtttgtcgtgattcaatttttatttataacctctacccggagcaaattcaggtaggtcatgcataaaaatatctttctatactacgaaaattatttttgtgaaagtattgacaacgctaactatttttaattatatattcatgatgctctaggcatcacattttctccatggggtattccctccgccggcactatgtgttgctggcgtttttttatcaattcttactttttaatcccactgtcctttccaccagaaacatacctcgtttctactgtattttgagaatatagttcccagaataccaattatatataatacgttgtaatatatgtattccaattaaagccgttattataataattatcatatatggttattttcatattgatttcgtcagaaatagaaaatgctgatgatgaattgtgaataatcaaactgacctctaattatcctgtatggagtagtgcttattttcgactcaatttctactgattagattatggttatcagtacagtgggttatgaaaaacggactggatctgccagcagtgcttctattattattcaaaaagaacttcagccggacaatgctataatccagggaaaggctataagctctgttggacggaatgtggaaatcagcactggtaaaaggggaactgacattaacacaagaaggattcctgcaagcaactgcttatctgcccggaacgcagaattaaagcataaccacacaggagccagaatactgtggtcgtacgcattcagtattgtgacaactaatagaaataaaaatctggccggtgcgaatattaaacgatgcgataccgtatagtgtaagtcaaaagtaacggggtatttaaaccatctttttatatttatttaacataatgcagattctgatgtattagttcagttgttcgccagaatcagcgctcgatcactatgcgttttagcagtgtgctgaagaagttcttcatcactgcgttattcagaccgtttcctttgtgcggcatattttgtgctactccatggggctttaactttgcctatagcctgcaattcgatattgccaaccctgatccatatgcagcgacggggcatcctctggccgggcactgtgaatgcatcgtatagcatcgtattaacgatgctccatcaccgacctttctgacaagctgtaggagataatttcccggttaaacagatcggagaactggcgacaggtaccacttttcccctgtaccgagaactctgtaacatccgctcccatttttcgttggcctttgtcaaagttccggctcaggatattgggcgcagatcacttatttggtggacaccactttgtcggatgcttcagattatgaccagatggatttcgctggacgcttacgattacatgcaccatattgtcaacgattacgccactgagtgtatgacacacattaaagcgttaggctcaggccttattacaatgtcatgctagtgtgcttgtacgccgtaaatatctgcatgataccagaatgaccggcaaactcgtcagtggatataaagaaaatcaagtgcgctgataacgatgccacatctgtggttggtggcaatatgcagattgttgttatttgtcttcattgcattctaagaagtgtttcttatcagacctgatttttttgccattatttttaatgaggtcttcaagtggaaaataggttaggcgttcatgtggcagcgcggcacgtccccatttagtggcaaactcccgttggcgtgcctgtaacagttgctccagcctttttattttgttctcattcatccggttttcctcgtatgctgcatcacaccactgtgctaatgaaaaatgtaatcagtgtggtggacgtgttttatccgcattggaattgtcgtcaactaaaggagatgaggcccgtttgtatcgcaatgggtctatggcgctcatgcccgtttgctgttcgataatggcttctctgagcatacggtgttgcagttctcgtaaaaactttgcgtcttctggtgataaatccattgttattactcgtaaagcaatgcgctgtagtgccttacgctaccgcgctgatggttcttatccgttttattgaatcggagaacaaactgtgagctatcagcctggtggtctggttttgcctgatttaagccgccgtgggtatttgtccaagaatgcttcaagctccaatcgttttggcctggtgaatggagatgggttaagcaaagactctcgttgctggtgtactttttcgcgctggcgctcaagcatggataatgcgattgcctgtagttcttcgttagtcattgtctgcacctgggaagcaatttaccggagtacctcacactacggcaaaaatgttttattgttgcaacttgcgtaattattcaggtcagtttggaacgcactgtataaacataaataacctgatactgttgtgtgttttcaaagaaaacacaggtatttttcacataaaccttccccttttcatatccgaccacttaatcaaaaaacggttttatacttgttgcccccactggggtcatcttgggtgacttttaacgtcaggtgacgcattgtcacttcagacctgctacctatacgccggaatataatggtcagagaggcatatttcgacgcccctaatctggggcgtttgattcaggatgtctggaacaatccgggctttgtgtcaccgggcgcatcaaagctgtaccacccgggatgtggcgctggatcgtcatttaccggactgcgaagacatacttaaagaggtgatatgggcgttcagtgattttgtccgcgataatcgtggtgtgtatgatccggaagcccgttaccccgccggtaatccctggtatcccgtaacaggccagttctgaaagcacagctcagtagatttcccgcattcgcacaatcttcataaatctcacaggacattctgaccatgttgactacaacaagccacgacagcgtatttctgcgtgccgataattccctgatcgacatgaactatatcaccagtttcaccggtatgaccgacaaatggttttacaagttgatcagtgaaggccatttccctaaacccatcaaactggggcgcagcagccgctggtacaaaagtgaagtggagcagtggaagtgaagtagagcagtggatgtagcaacgaatcgaggaatcctggggggcagcagcatgaaacgtgttgtaatgccggtacgctggcaatgtgcaaaatgccagcgctggtattgtggaacccggccctgcccttggtgctggcgatattcccgttcatcttcctgctgataccttccgttcagcagcgggttgttatcccttcctgactgattcgtcattccattcttattgattagaactggcattacaccggtgccggcgtgctttcctgcgtgtctgcgccggttcagtaaattagaaaagaaacatttgtcagcgccagtgatataaggcgtaacggctaacaatcttggcgttaatacattccgagcaaataaccgaagcgttacttttagtgacggggttatccaatacttttctagtcagtgtttagtatttatgcaagcgatataagtagtcaccgcttagactattgacattcatgatgcctgttaattcaaatttcaggtatgatcagtcatttattgttgtgatactgattccgctagtttagcataactgtcctgcaaatcattgttcaaaaaagaaagctcctacaaactgtatcctgaatctctaccagaagataatatacttggttatttttgtgcataagctcacataaaaataatattaattatgttttcttagagatagaaaaataaacaggtaagcagaagacggacttttttaatgcgaaaacgtattctttttattggcccaccgctgtacggtttgttatacccattgatttctctggctcaggcctttcgtgtaattggacatgatgtagtaattagtagcgctggcaaattcgcgaataaagcagcagaagctggactggttgtttttgatgcagttccaggtttagattcagaggctggatatcgccatcaggaagagttgaggaaaaaaagtaatattattggtcatttctctttttttagcgatgaaatggcagataacctcatcgattttgcaggaaaatggaggccagatttaatagtctatccccctcttgatccggcaggcccattggttgctgctaaatatagaattccttcagtgatgctggctgttggattcgcgcatacatctgcccatattcagatgttaaaccgttctttaagcaatgcttacaggcggcatggagtcagcggtccactatgtgatttagcatggattgatgttgctcccccaagtatgagcattcttaaaaatgctggagaaccggttatctcaatgagatatattccttataacggaggtgctgtaaaggaaacatggtgggacagggattctgatcggaaacgtttacttatcagccttggcactgtaaaaccaatggttgatggtctggagctgatttcatgggttatggattctgcaaatgaagttgatgctgatatcattttgcaacttgcaataaatgctcgtactggtttacgaaaactaccatcaaatgtacgtctggttgactggatacctatgggtgtattccttaatggagctgatggatttattcatcacggtggcgcaggtaataccctgacagcgctgtatagtggaataccacagattgtgtttggcgaaggtgcagatcgctctgttaatgcagaaattgttgcgaagcgtgggtgtgggattattccggacaagcatggactgaccagtgatttggtaaatcgccttctttatgatgattcactacgcttctgttcagatcaggtagccgctgaaatggctgaacaacccagtcctgcagagattgcagaggttttgatgagaaaattaaaaaacaacgggaaacaattgtagcgtattgctgaaattttcaacgagaaatgttatgagtaatataatgtccttcatcacataaatgaaggacatcactaaataaatgagatagtctcccataataatattgcagaaagagttatctgacgataaaacgatattttacacagagttattatttgataccttcctgcaattataatttgctaattcatcaataattgctccgcgccaccaggcataatcgtgaccaccggtatagacagtgaggttactttccaaaccagctgcgattaacgaatgatgcaatcgctgaacatgtgagacggttgtaccttctaaagaaccgactccaagtcgaatatttacatctttcggaggcgctgaaagtatctgctcacttacccaggaggtattattctcaggtaatgactccaacttactgatagtgttttatgttcagataatgcccgatgaccttgtcatgcagctccaccgattttgagaacgacagtgacttccgtcccagccttgccagatgttgtctcagattcagattatgtcgctcaatgcgctgagtgtaacgcttgctgataacgtgcagctttcccttcaggcgtgattcatacagcggccagccatccgtcatccataccacgacctcaaaggccgacagcaggctcagaagacgctccagtgtggccagagtgcgttcaccgaagacgtgcgccacaaccgtcctccgtatcctgtcatacgcgtaaaacagccagcgctgacgtgatttagcaccgacgtagccccactgttcgtccatttcagcgcagacaatcacatcactgcccggttgtatgcgcgaggttaccgactgcggcctgagttttttaagtgacgtaaaaccgtgttgaggccaacgcccataatgcgtgcactggcgcgacatccgacgccattcatggccatatcaatgattttctggtgcttaccgggctgagaggcggtgtaagtgaactgtagttgccatgttttacggcaaggagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattaccagaaaatgataaggtaaacattgaaaagcagccgactgatgactgttttttatagttgcatttttattttttgttattttcatttatattcccttacttgtcgtttaaaattcttctatataacaggaagaggtaaccatagaatgaacgtttattttcctgtatcagaacagccataacttttattttatagttgttatcagtgaatgaatgcaacctaatagaacaatgaggaaaacaatggagaaaaagcgacggaccggacgccatagttcatattctcgtgtatcagcctcacgtatcaacctttctgaaatggtttcggtttcttttcctcgcaccagaatatgtctgtaatatttcctcatgacatataccgaaaactgaaaccagattaatatggatggacacacaacacataaacttctgatgatatcacccgggaaagtatcttgggcgggtaaaagaaagtcatatactctggataaaatcatcatcgagataaatgagacgccagcacctatccagtattcgatatgagaagatgctgcattatatgcgtcagtaaaatttttctttcttaatgaaggtggaagtgctgaaagttcaggaatacgttttcttgtccagtatattttcatatagtaactcatataaaaagtgttctactttactatgatgatgacgatttataaaaggcttataatgactacttctcctttcattctcgaatttcacgataatgatagagataatcattatcaattgatagtatcagtaattttgacttacatcacactttcatggtttaatcaggtgattgatttaatgaaaagagtgtgtttgtggatgtattgtgtatatgtcctaccgggcatctgttcttacattaattaatatattgctatttaagtattggtagtattgtcagtaacattcttttggttaatttagttattattcctcactgattaattgtccttccgttcttattgtttgtaacttgtgtttgtatcgtacctttcaggtgttgatgcgcgctttactgtgtctgcaccggcttgacaaaattcaacaggggttgaaaaggaacatttcgtgcaaataaccgaagccttaatttcagagccgggggaaatccggcgttttgttcagcaggcggtggaccactggccaaatctgttggcatttcacttcacgctctattcggcagaaggaatctatggtcaacagattcagacattttgtagttcctttcaccgacgggtacacgaacgtattacggagcataatcacacggtcagcccatcagcgccggtggtattacgctggttgcgggaacaacatgaaggagcacagatacgatgtctgttgctgctcagccagacgagtatttgccatccgcgagtcggcgtcatggctgatgaagaatgtgcgcaactggtggatttactgcaacagacctggtcggtgataagtgctggcggacaatgccgggtggaaagatgttttcgggtggcccggcctggttcatcagggcaatacgtggcgttaaaaacggctgttcagtcctttatgtcgcaggttattgcaacaatcatccggtgattgtcgggaggaatatcaatgcttccgttaatttttactggctgataaagttttgtctgctgaatctttatacggaattcctttcagtatgcgtacacgaattgactatctggcggataaatactgttttacagaacggaacgaatccccccgtcttcgccggcagtggcaggatgttctggaggagtgccggcagacagaggccgggccagaagaacggttgcgtattgcactgctgaatgtggattacgtcaccagttttgaactgccttttcgcttgctgcttacccgtacaccgcaattgattgccgcgctgcgtgaagaatggggcatcagccagaaaaatgtggtgtttaacgataaacggtttggctgcgtgtacagcctgaaggccagcctttctggtgtgccggatacataccggtatcatctgtctcaccgtattcgtcgcgtggttgggaatgaaaacacatcattgccatatcagcaggttgcccgggaagtgaaagcgccccgtgaacggctgaagtatgcactggaggcgggtttactggtgactgcactggacggcctgttcaggtttggcagtcagcgtattgcggctgatgttctgaggctgagaaaggccggaatgccggtggtgaccacgaccgtggaggtgcacgataacctgacgggaacaacccgcaaagtaccggcataccatctctgatacaaccatcagggggaatattgctctggcagcagcagtatgacattctttatactttatccccgtgcctgaaaacatgtgctaaggaaacgggaatggcaaggtccgattatgatattatcaatctgtctctggaacatgaactgaatgagtggctggcagagagaggttatgccggactggtggataaccggaatcgcctggcagaagttgttacccgcaaattgcaggacagcttttatataaacgtttccagggatgcgctgaacacggcatacagtgaacacccggagtggttttctgggcttgtctccggggatgagaattaataagtggattatgctgctatcaggtagtgtgattgccggcagggatttcgttttattctgtttcttcccggggttcgggtttgaattttcccagaaagttgtacatcggtcgcatgcagggatgcggatagccgtcctgcataaacaccacccgggtttcctcaacactggtcagggtgacaagcgcaccatgatcgtctttgtatcgctgattgactttcggtaatggaacatcttctgacataaattttagtacggtaacagttaactaaattttcatgtggtagcactgaatcaggagactgcgtttcctgatgtgcgctgttaattttctgtttttacgaaacattttccccttcttcctgtgtattttattgcgctcctcctttcatgtccttcccatatcctgaaactcacttaaatgctgttgaatcgtcaaacattgcaactttcaatgactgaaatcaaaaattgctattttttaagctaaccaactgtattaaaagcattcagtggaataattttctgcacttttccagtaattatggttataaattttgtaatgtgctgtttttgcgatatttgtcagaataaagaactgttcatttgtgttatatcgatcgataaatctgtcatgttgctgtagttcagatcattattctataatgatcaaaattaagtcaattctagctggtttgttactcagcattctggtaccggttgatgcgggtaaataccggaagggcggtagcgtgccatcgcaaaacatggtgggaggtatcgtcaggaggctggtgaaccgccccggttttcctggagagtgttttatctgtgaactcaggctgccagatcatcgtttctgatggaagcataataagctttttctgcttctgccggagggatatgacccagccttcccagcaatcgtcgattgttataccagtccacccacgtgagtgtggccagttccacttctgcacggtttttccagctcttacggtgtattacctccgctttgtaaagaccattgatgctctccgccatcgcgttgtcatacgagtcacctgtactccctgttgatgccagcagttttgcttcttttagtcgctccgtataggccagtgatatatactgagaacctttatcactgtgatggactgtgccggacggccgacgggcccacaacgcctgctccagtgcatccagcacgaatgtcgtttccatagacgatgagactcgccaccccacgatacatccggcaaacacatcaatgatgaacgccacatagacgaagccctgccatgtgctgacgtaagtaaaatcagccacccacagctggtcaggacgttctgccacgaactgacggtttacgcggtcgcctgcggaaacggctttccggctgacggtagtacggacctttttaccccggagaacaccggcaagtcccataaccgccatgaggcgcgccactgtacatctggccaccctgataccttcgcgtaacaactggcgccagactttacgcacaccgtacacctgatgattttcatcgtatacgcgctgtatctctctcttcagccagtcatcgcgctgagcacgggcactgcgtttatcaggatgatgtcgctgttgctgacagtggtaatacgttgacggggcaatatgcagttcactgcataccggtccgaccccgtactgctcatgcagcttatccagcagcggcattattttttccagaggcggtcgaactccgccttcgcaaaataagcggaagcctggcgaaggatatcgttactgcggcgcagttcacgattttcacgttccagctctttcagacgctgacgttcagcggtggtgagtccaccatcaccactcccggtatcccgctcatgctgacgaacccacacacgcagagtctctggtgtacagccaatctttggggcaatggaacaaattgccgcccattgtgagtcatattcgccctgactttccagaaccatacgaactgctcgttgacggacctcgggggaaaaacgtgtatttttagtcatcctgtttacctctttctcagggagtttagtctccaggattcccggggcggttcatggtgattgttggtatgacatgaataaaaggtttttcgtttgactggaaaattatgttgcaggaacgagaggactgaggaacaaagcttattccggcgctgtccgtccttgctgtcactgacactgatgtctgctttattatcgcctttatctcttcaggcagcggatgtccggcgtagcggagatgaagcatttatcattcagcagcagcgtcaggaagcccttgagcaacaactgacgccttcagcccctgatgttcgcctttctgcacctggctcttttgcccataagattaattttcctgttgaaacgccctgttttcagattaaacagacggaactgaagggggctgatgcgttaccacactggctgcctttacaaaaaatcgccaacggggcggtcgggcattgcctgggggcgaaaggaattaatctgctgatgagtacattgcagaaccgtctggtcgatcatggttatgtcaccacccgtgttctggcaccttcgcaggatttaaaaagcggtatcctccggctggttattattcccggtgttgtgcgacatgtgcgtctgacaccggacagtgatgactatattcagttgtattcctcattcccggcacacgaaggttctctgctggatttacgggacattgagcaggggctggatttaggtaacagccggatacagggacaacatactgagctgaatgcaaccagtggaaatctgtctacacagaatgcgcaactgagtgccgatacgctttccgcccggactgccgggcagttcagcagtaatggcggtacgataaatgccgacacactgcagatatcggcacaaagcctgtcaaatcgtaaaggcagtctgattcagacgggaacaggggatttttcgctgagtctgccgggaagcgtggataaccgggaagggctgcttgcggcaaatggcgcggtgcgtctggatgcactgagccttgataatcgcaaggggaaagtgcaggcggagcagtcaccctcccttcagaaatccccgcccacgtttctgaaaccgtttgtggctggtgtctgtgcggcattgctggcggtcagcgtggctattccgggatggcagtttctgacacagccatcaccggaggagcagcattttacctgggggaatggttgtaaaaagcagtgaaaacagtaaatacagagtatcgtgatgaattagtgctcaggggctaccagtattcaataaccagcgtatcggcatcgcattcctgtaattctggtattgactgttatgactaaattcaatgtatatatggcaggcagaaatatgttaacagtcccggagttgtggaaaatcctccggagctaatatcgggagtgccttaacaattttccgtaagttaaatgataatttctgagtaagaatatggtcacgatttgtgttgacggtgaaaataagactcataaaattaccgactggacgctgtgggctggaaatgacgacagagaggttatgctgacctgtcattttcgcagcgggagaaaatatactcgtccgctttctgtatgtcagataacgccaactgtaaatttgcgaaatgttttcctcgaaaggaaagggaacgctgtaacatcccgggctgaactggttattatatatggtgataaatatgctgctgtttattaccgcgagggtgaacgaccctacatcatgaaaacgaccggccttgactttcaacagtgttcagcatttacagagcatgccgtgtttaattacttgtgtagggtggctaatgaacgtattttttatgcccgtggtaataacagaaatatcgatgagaatatccttaggcagataaagaaaatagttcctcatccggataccgccttgcatgcatactgttcaggacagagtaaaaacgtgattcgccatggggtttgatttttccgtttggtcttaatgaaagtcagttgctggctgtcgaacgggcattttcctcacagatttcagttattgaaggaccacctggaacaggtaaaacacagactatactcaatattgttgctaatatattaattcagaataaaacagtggcaattttgtccaataataactcagctgtcagtaatgtttatgaaaagatggacaaacagcaactgggatatgtgatggcacgactggggagtacggagaacaggcaacagtttttttcaacgtcgatttcgcgttctgaggaagtcttacctgactcaccgtctgcaaatgcgattgatgatgtacttcaacaagtgaaaaaacacctgaatgccattaaccaggtcgcttcgttaaaagcagaaattaatgagctgaatattgagtataaatacctgcagcaatggcagagtcagaatcttcgaccggaggagcttttttctcacaaataccgattttcctcacaaaaaacaaccgacctgatggcttatattcattacctttctgacaggcggattggattcagaaacagaattgatttgttgttaaacttcatgatactgaaagtcaaaccattgatgattccggagagaaggctggcgctatttacttctcttcagctttcttattatgaaaaaaatatccgggaaaaacaaatttctctgaatgaatatgaggaagcatttaaaaaatctgattttaaaattttactggggcgcctgacatcatggtctatgctttatttaaagcaacatctgcgaagaaatgtttcaacaagaagttcattctcggcagagacatacagggatgaatttgaccgttttataaagcgttttccgattattggtagcagtacgcattcgattattaactctatcggcaagggggcccttcttgattatgttattattgatgaagcctcgcagcaggatattgttccgggcattctgggactgggatgtgcccgtaatgtaatcgttgtaggggatcgtaagcaacttccacatgttcctgtattactcccgaacagcccatctccaccggcagaatactataattgtgagaaatatagtctacttgattcggtttgtatgttgttcaggaacatggtgccagtaacccttcttaaagagcattatcgttgtcatcctaaaatcattcaattttgtaataagcagttttatgataatgctctgataccgttaacggttgattccggtgaagcctcattatctctggtcatcacggcaaaaggaaaccatacccgtaatttttcaaatctcagggagcttgaatctctggaaggtcattactgggatgaagaaagtagcaggggatacattgccccatataatgcacaggttaatctggctgaaaaagtgctgcctgctgattttgtgaaatcgacggtgcataaatttcagggacgggagtgcgatgaaattgtgttttccactgtgctggataagaagcgcagcagccagcacagtcggaacatcgcgtttgttgataatcctgaactggtgaatgtcgctgtttcaagggcccgaaataaatttacgctggtgactggtaatgatgtatttgaacgccacgctggacatattgcggcgctgattcgttacatcaaatactacgctgatgacggagagattttcgagagcccggtcatatcagcatttgatttgctgtacagtgagtatgacaaatcactggaacgactgaatagtagattgaattcaaatgattcacactttaagtcagaacagattgtggcctgcctgttgcgggatatcctgtcgcaggatagttatcggagtatgatgtttcattcacaaatagcgctgaatcagttggtgttgctggagcggggggattttacacaccgtgaacagttattcatgcgtaaccgggccagttgtgactttgttgtttactataaggtcgggaagactccattaggggttattgaagtggatggaggttatcatctgaccagtgttcaggctgaacgtgatgaacttaaaaacagtatactgaagaaatgcggcctgccattgctaagattacgtactatagacagtgatatagaagggaagttgggagcgtttctgtcaggcctgacaggctaaaatctgaataaaaaatattgcagcgggaggtctcaaacctgatttggtcatgtgccacacacaattgtacgaaccccatggacacaggcttctttgttttggttacatcaacgtacgtattcctgatacatataaaaataagtgctattgctcaaagctaacagggaatgtttctgttgaataattccttagtgaataaactttatcagggggtaattctattacagtgaatacttcctgcaaaatgatatttgaattgttcaccatctgcatcatattttcttatttacaagttgaaaggatagtatatgttgaaaatgcatggattttccaggtgtgttaccagtaagaagcaggtggataaaggatgtgataacaaatccaacaaccaggttaatatctgaagatttttgttgttattatttatccccaaagcggtgagttattaatgaagtttgcctgaatgtataaacagaattattcgacataaagccaggaaaatgagtgatacgcttttaaccgaaaaaatccttaccggagaaaatgttttgcgtgctgcaatcgcccgcattgagtggatttttgaaacatttccgtcggtatgtctgtctttttcaggtggaaaggattccaccgtgcttttccatcttgtggcagaggtggcccgcaggagaaaacgtcatttctctgttctgttcattgactgggaggcccagtatcggtgcaccattgaacatattcagaagatgcgggaaatgtaccatgatgtgacggaaaccttttactgggtggcacttcccctgaccacggtaaacggcgtctcgcagtttcagccggagtggatatgctgggagccaggagtgacctgggttcgccagccaccggaagaggccattacggatatgacatattttccctttttccggtatgccatgacgtttgaagaatttgttccggcattttcttcctggtttgccggtaaccggtgtggagtggcagtgctgaccggtgttcgtgcggatgaatccctcaatcgctttatggggctggtgtctcagcgcaaactgagatatgccgatgataagccctggaccacggcatcgcctgaagggttttattacaccatgtatccgttgtatgactggaaagcccgcgatatctggatatataacgccagagcttgtgccatttacaatcctctgtatgacctgatgtaccgtgccgacgtgccgttacgcaacatgcgtgtctgtgaaccttttggtcctgaacaacgtaaggggctgtggctttaccatgttctggagccggaaacctgggccaggatgtgtgagcgggtgtcaggcgctgccagcggggcgctttatgccaatgaaagcggtgcctattttgccctgcgtaaacgtatatcaaaaccagcccatcatacctggcgcagctatgcgatgttcctgctggatgtgatgccggaaagaacggcagaacattaccgtaataaaattgctgtctacctgcgctggtatcagacgcggggcttcccggatgacatcccggatgaacaggagaatgacctggggagccgggatattccgtcctggcggcgtatctgtaagacacttataaagaatgatttctggtgccggcccctctccttcagtccgaacaaaccccggcactatgaacgttatctgcagcgtatgaaagaaaggaggaaggaatgggggattctgtgacaccggagataattggcaacatgattcgtcagtacttcagccaggaacgaccagaagaagagaccatacaggcccttaatcacctgcgcagagtgcttcatgaagtcagtccttttgcacatgagccagtggactgtgtgctgtgggtaaaagcagatgaggtggtggccaatgattacaatcctaatgtcatggcgccgggtgagaagaaactgctgaagcagtcactggagaaagatggtttcacacaaccggtggtggtgtctgaggaaaagaaccattacctggtggtggatggttttcatcgccaggtgctgggcagggaagcaggtacgggaaaacgtctgaagggctggctgccggtggtctgtattaatccggagagaaagggacaggcctcacgtattgctgcgaccatccgacataaccgggccaggggcaaacatcagataacctcaatgtctgatattgtcagggacctgtcgcgcctgggctggacgaatgaacgcattggtacggagctgggtatggaccaggatgaagttctcagattgaaacagattagcgggctgacggagctgtttcaggaagaggatttcagcccggcatggacggttcgctgagaccgtcagatatgtatattatttcagtgagttaatgttttgagcaggaaaaagagtaccccggaagttgtggaagacatggttgcgcagaaactggaggctgctggttgctggcgcagagcttctgaccgctggctttttgttatgggaaatgttgaatgtacagaagcacaacgggagtggttgttgttgcgccggaattattgtctggcgcagatatcgtccccgccgctacctgaaacgctggatatcagcgaggtggcgaaagctgcagatgccacgctgaggcgaatggggattgccactccgtccggggaggtattcagaaaaggtacaccggtctgttgatattcaggtaacaggtattaatgatgaagcaaggaatggcaaacagtatatcaatgacatggcaacttttatgcgatgaacatggttttacccgggagcactacaatcagctgaagaagttcagcccggagacattacgtgaaattattgctgaaatagccagctgtcatccatcaaccagtgtattgctcaggaataagtggctgacaccgccggaggatattctggagcagattacccgtgaatacgaacgaagaatacaaaactgtccaccgttcaggagcgagaaggaagcggaatcctggttaaatgaactatcttttgctgtgattgctccgctataccgtgttgcccccgaacaaacagaacaggttgagtcctttgttctgcagcttattgccgagcaggagcgggtttgggagcttattttaaccaatgatggttattcatggcattgcgcactttatgatatattatttcatctggttttacgaaatatggaagaccagcctgaacatcagaaacagcgaataacaaaaatattttatgagcccgatgcaagactggttgcagaagagattaaattccggattcaatctctgtatgatgatgaacaaaagagagctttaagtgaactggtaaatgattttacttcaaaagaataaaatgcggcgaggtgatttttactatatgttaataaaacggggggtagatgaaagtgaatggtgttactacatcaaaatatgaaggatggcgagggacgtttcagttatatagatataaaacggtagttctggtgcaccccaaaggatatctggcaggggaaatgattcatcgccaggccctaacgtcgtcttgtcaagattaatgctatagacatagctaaattttttatggataaggatatgaactgtgcctcaggtccggaacatcctgtagggactttttaagtcgggattgagctgaactaatgccaaattatgaacagggaaattcagcagcggctacagtgggtaaaactctatgaaacgtccggtgatgcgggatttgtatgccgtcgctgtggcatttctcggcccacattgcgtaaaatggtggcgcagatatctggctcagggcatcgctggtctggaaagccacagccgtcgccccaagcgttcaccatcaacgaaaaccggcacttgcgaagtcgctctgattctggagttacgttctcagcgaaatctgggggcaagacgtattcaaagcgagttaaaacgacttcattcaatctcactggcaatagcaacaatccacaaagtccttttccagaatcaggtttgaaccgccccgggtttcctggagagtgttttatctgtgaactcaggctgccagatcatcgtttccgatggaagcataataagctttttctgcttctgccggaggagtatggcccagcctttccagcaatcgtcgattgttataccagtccacccacgtgagtgtggccagttccacttctgcacggtttttccagctcttacggtgtattacctccgctttgtaaagaccattgatgctctccgccatcgcgttgtcagtaagcgtaaactgaccgccgtatgtagccatcagacgaaaattggtaacttagacgcccatctgatatagacggacatctaagtatggaattacaggactggcgaaaagaacctcgtaaaaactattcgaatgaattcaaacttcgtatggtggaactggcatcacaaccaggagcctctgttgcccgtattgcccgggaacacgatatcaatgataacctcctgttcaaatggctcaggctctggcagaacgaagggcgtatatcacggcgtcttcaggtaacgacctcttctgacactggcgttgaattattacctgtagaaataacgccggatgagcagaaagaaccggtggcggccattgcgccgtctttatccacttccactcagaccagtgtcagtgccggctcctgcaaggtggagttccgtcacggtaacatgacgctggaaaatccatcgccagagctgctcacgctgttgatccgtgaactgaccgggaggggacgatgatctcactcccgtcaggtacccgcatctggctcgttgccgacgttaccgatatgcgtaaatccttcaacggatacgacatatgctgaaggaggagcagtaatggattaagtgataacaaatacccagaaatagaggttcaaatccagcttagttagtacataaatactattttgatgaaaattattatatgtttcctcagattttaatcaggcgcccagattaaaccaagtattgagcgcctgattatgtttattcattaatatctgtcattgattgtcttattatcagctatccccgtattaatcagagttttcatttatttttaatgcataatcagatgccgcctcatcattatcctcagtattatcatagccgaaaacttctcccggacacgggcgttcacgataatagtcatcgtcatagttttcatcgtcagataatgatatgtcgtattctgaatatgattcaccacaattatacatgaaatcatctcctttggggggggcaataattagtgagtttattcgaaaaaatgatgagcgccagaccaatccacccaacttttgattataatcatgaagatacttgtctcagtacaaattgaatcaaactcaatgcagcatgattcacctttatattctctcagggaaaccaaataccactactcaactattaagaacaaaattcgggatgtatgattatcagaagatacctgcatcctaaataatttcagacagatattatcgttgtgaatcccccgccacctttccggtgcgcggggttttgtcttttttcaccgggaatacatgtatgaatccgtctgatgccattgaggcaattgaaaaaccgctctcctccctgccttactcgctttcccgtcacatcctggaacatctgcgcaaactcaccagtcacgaacccgtgattggcattatgggtaaaagcggggccggtaaatcctcactctgtaatgcactgtttcagggggaggtcaccccggtcagtgatgttcacgccggcacccgggaagtgcggcgcttccgtctgagtggccatggtcacagcatggttatcactgacctgcccggggtgggcgagagccgggacagggatgcagagtatgaagccctgtaccgtgacattctgcctgaactggacttggtactgtggctgattaaagccgatgaccgtgccctgtctgtggatgagtatttctggcgacacatactgcaccggggacatcagcaggtgctgtttgtggtgacgcaggccgacaaaacagagccctgccatgaatgggatatggcaggtattcagccttctcccgcacaggaacagaacattcgcgaaaaaacagatgcggtattccggctgttccggcccgtacatccggttgttgccgtatcggcccgcaccggctgggaactggatacgctggtcagtgcgctcatgacagcgcttcccgaccatgccgccagtcccctgatgacccgcctgcaggacgagctgtgcacggaatctgtctgggggcaggcccgtgaacagtttaccggtgcggtggaccggatatttgacacggtggagagcgtctgtgttgcctctgttgcacgcacagttctgcgtgccgtccgtgacacggtggtctctgttgcccgcgcggtatggaactggattttcttctgaacagtctgccaggggaaatgtctgattacattgcgttaaccaactgaaaacatgatacaaacacctcatgcccctcctgtttctcttgcgtgactgctctactgttaatagaataaaacgatcgataaaacaggtatcgatcgtttatatcgatcgtttatagtggttaatggcctgcgaaaaggcagctgaatctcttcatcatgcagaacggaattgcacacaacagactgatacttctctgtctgatgaagggggagagcgtttacgcccgggacgtatcgctgtgcccgataactctgttttgtacctgccggtatccacttttgtgggtaccggcttttttattcaccctctgtaaggaaaagctgatgaaacgacatctgaacaccagctacaggctggtatggaatcacattacgggcaccctggtggtggcctccgaactggcccgctcacggggaaaacgcgccggtgtggcggttgcgctgtctcttgctgctgtcacatcagtcccggcactggctgctgacaaggttgtacaggcgggagaaaccgtgaacgatggaacactgacaaatcatgacaaccagattgtcttcggtacggccaacggaatgaccatcagtaccgggctggaactggggccggacagtgaagaaaacaccggtgggcaatggatacagaatggcgggatagccggaaacaccactgtcaccacaaatggtcgtcaggtcgtgctggaggggggaacagccagtgatacggttattcgtgacggcgggggacagagcctgaacggactggcggtgaacaccacactgaataacagaggcgagcagtgggtgcatgagggcggggttgccaccggtacaattatcaaccgcgacggttaccagagcgttaaaagtggcgggctggcaacaggaaccatcatcaacaccggcgcagaaggcggccctgattctgacaactcgtatacgggtcagaaggtccagggaacagcagaatccaccaccatcaacaaaaatggacggcagattatcttattttccgggctagcccgtgacactctcatttacgcaggtggtgaccagtcggtacacggaagggccctgaataccacactgaatggcggttaccaatatgtgcacagggacggacttgcgctgaacacggtaattaacgaggggggctggcaggttgttaaggcaggtggcgctgccggtaacaccaccataaatcagaacggtgaactgagggtacatgccggcggggaagccactgcagtcacccagaacacgggcggtgcactggttaccagtactgctgcaactgtcatcggcacaaaccgtctggggaatttcacggtggaaaacggtaaggctgacggtgttgttctggaatccggcggtcgtctggatgtactggagagccattcagcacagaataccctagtggatgacggcggtaccctggcagtgtctgccggcggtaaggcgacaagtgtcaccataacatccggtggtgccctgattgcagacagtggtgccactgttgaggggaccaatgccagcggtaagttcagtattgatggcacatccggtcaggccagcggcctgctgctggaaaatggcggcagctttacggttaatgccgggggacaggctggcaacaccactgtcggacatcgtggaacactgacgctggctgccgggggaagtctgagtggcagaacacagctcagtaaaggcgccagtatggtactgaatggtgatgtggtcagtaccggcgatattgttaacgcaggggagattcgctttgataatcagacgacaccgaatgccgcgctgagccgtgctgttgcaaaaagtaactccccggtaacgttccataaactgaccaccacgaacctcaccggccagggcggcaccatcaatatgcgtgttcgccttgatggcagcaatgcctctgaccagctggtgattaatggtggtcaggcaaccggcaaaacctggcttgcgtttacaaatgtcggaaacagcaacctcggggtggcaaccaccggacagggtatccgggttgtggatgcacagaatggcgccaccacagaagaaggtgcgtttgccctgagtcgcccgcttcaggccggcgcctttaactacaccctgaaccgtgacagcgatgaagactggtacctgcgcagtgaaaatgcttatcgtgctgaagtccccctgtatacatccatgttgacacaggcaatggactatgaccggattctggcaggctcccgcagccatcagaccggtgtaaacggtgaaaataacagcgtccgtctcagcattcagggcggtcatctcggtcacgataacaacggcggtattgcccgtggagccacgccggaaagcagcggcagctatggcttcgtccgtctggagggtgacctgctcagaacagaggttgccggtatgtctctgacgacaggggtgtatggtgctgcaggccattcttccgttgatgttaaggatgatgacggttcccgcgccggcacggtccgggatgatgccggcagtctgggcggatacctgaatctggtacacacatcctccggcctgtgggctgacattgtggcccagggaacccgtcacagcatgaaagcgtcatcggacaataacgacttccgcgcccggggctggggctggctgggctcactggaaaccggtctgcccttcagtatcactgacaatctgatgctggagccacaactgcagtacacctggcagggactctccctggatgacggccaggataacgccggttatgtgaagttcgggcatggcagtgcacaacatgtgcgtgccggtttccgtctgggcagccacaacgatatgacctttggtgaaggcacctcatcccgtgacaccctgcgcgacagtgcaaaacacagtgtgagtgaactgccggtgaactggtgggtacagccttctgttatccgcaccttcagctcccggggtgacatgagcatggggacagccgcagccggcagtaacatgacgttctcaccgtcccggaatggcacgtcactggacctgcaggccggactggaagcccgtatccgggaaaatatcaccctgggcgttcaggccggttatgcccacagcgtcagcggcagcagcgctgaaggctataacggtcaggctacgctgaatatgactttctgattatacggtatcccggaaatacgatttcaggaaaattcatgcagtaatgggaaaggacgctcattgctgttcaccgcagttctgaattattgaatttataaaggtgaatgatgcacgaaaagaacatcgccctgctttgtgatgaagccgaccggcttttgcaactgaatatcaatctgctccggcaaatggttgatgagccggatgtgttatctgacagtaagaacgaaaacgggctgctttttgataaacggaaagcgctgaaaagaattgaggagctggagggcgaacaaatcaaaaccgcccgcagggagatggtgctggctgtggtcggcacgatgaaggcgggcaaatcaaccaccatcaacgccattgtggggcaggaaattctgcccaaccgtaaccgccccatgacctcggtaccgacattgatccgccacgttcccggaaaaacggaaccggtcctccatctggaacatattcagcccgtccgcaatttattaatcacactgcaggaaaaactcgccaccccggcagggcagcaagtcgcacagtccctgcagcaaaccggggatacccgcgaactactggatattctggcggatgatgtctggcttaaaaatgaataccacggggaagacgaaatctttaccggactggcatcgttaaatgacctggttcgtcttgctgcggcaatggggactgaatttccttttgacgaatacgcagaagtgcagaaactaccggtgatcgacgtggcgttcagccacctggtgggaatggatgcatgtcagggaacactcacactgctggatacccccggccctaatgaagccggacaaccacagatggaaatgatgatgcgggatcaactacagaaagcctctgcggtgctggcggtgatggattacacccagatgaactcgaaagccgatgaggaggttcgtaaagagcttaatgccattgctgacgtctcagccggtcgtctgtttgtgctggtcaataaattcgatgaaaaagatcgcaatggtgatggtgcggatgccgtacgccagaaggtgccagcaatgctgaacagcgatgtgctgcccgcctcccgcgtttatcccggctcatcacgtcaggcgtacctggctaaccgtgcgcttcatgagttacgaaaaaacggtgcgcttccggttgatgaagcctgggtcgatgattttatcagggaagctttcggacctatggtggaagaggacgactggaaagacagcactaaggtaaataaaaaggcagaaaaactctggaatatatctctgatcgatcaactgataacggaagtcatacagagctcccattccagagcggcggcactggcggttgactctgccgccgcaaaactgatgcagaatgcagaaaatgtcagcgaatatctgtcattacgtcatcaggggctgcagcaaagcattcagtcactacaggcgcatattaccagcctgctggcggatatccaggagattgaggaatgtcagaatcaggtgaccggtgatgtcagaatggccatggaggacatcaataccaaaaccggggaattactgacgaaggtctgtgcctcactggaggaggagctgaacgactatttcagaagcggtaaacgcaaagaacagcaaatgctggaggaagaaaattcagcgcagccccgggagagaaacgcattcgctttctttcacgatattttcggaaccggaaatcagcatgacaggatgcgggactttgatccggacagccccgaaataaaattcagtgatcgcagggcagcccttgaactgatgacgcaaatcgaatcgaccgtgaccagcctgcaccgtgaggctgaagcacagttccggcctgagctggagaaaatcgtcagcgggattgaaacaggttttcgtggcacggccctgtacgccacagaaaacattgccggtcgcatcaatgcccgcctggaggatgagggctttaccgtaaaaatcagttttccggcagtcagccagttacagacccggctcgcggtaaaaataaatctgagtgcgcttatggaggaaagaacggagaccgtcacccgtcgccgtcggcagagtggcgtatggggaaccgtttgtcgatggtttggcaccagtgacctgggctgggaaaactatgacgaggatgtgagtcgcagcgtgatcaatatcaacaaggccagagaggaagttatgtcactgacccgggcatatttcggggagctgcaggcatccattgagcaggatattaaccagcccgtccgccaggaaatcgatgcctttttctgcgcattcagggagaaagttgaacaactgcgtaacacgctgattcagagctctgaagatcataaacgcgatcagcaggcgcaggaacggcttaccgggcgacttcaggcattaaatgaaagggttcctgagctcattactgacagtaaggcgctgagggaagagctggagacaatgctgtgacttcaccatttattcaacaaattgctgataaccgggtatgtcaggtactcacctgtcttcctgaaaaatttgtggttgatttcgcaaacggaatcgatgttgcacaggagcatatccgcacggccggagagcgcacgttcttccggcgtttaaaagaggggctgaccggcgaaggcgctgcacggcagaatgccatcaatgcgtcgcttgcacagggcgttgaggcgtccctgcgctggctgacggagatgacaacgtcacttgccaccacaaactacgcgattacccgggtaaacgacagggtcagttcactggtcagtgatacagccaggctggcgcattattccgcagatacgcgggagcagttactcaccctggccgatcaggttcaccataaactgaatcatcttgaagaaaaactccaccgtgttgaccaggttcagcgggcgcagttacatcttgagcagatattctcatggtggagcgccgggcgatatgcgtcattttcccctgccggacgttgttatgtggcacttgaagagcttcgctggggcgcgtttggtgatgtgatacgtcagggcgaaacaggccaggttaaccagctactggatattctcagacataaagcattaacgcagatggcacaggagagtggcggtagtgcaaccgtgcgtctgaacactctggactggcttggtggtcagggccgggagcaggcagataacgagtggcatgacgcgattaactggctgggagactggtgcagtgaagagcagcatccggtgatctggtcaaccacgcaggctgcagaacacttaccggttcgcatgcctcgcctctgctctgcagaacgcctctctgaaagtatggtcgatgaaatatttcagaagggggctgcatgagtacagaaatgaaaacggggctggtgctgtccggtggcggggcggtgggcgcttatcaggcgggagtggttaaggcactggcagagtgtggtacacagatcagcatggtttcagggaccagcattggcgcattcaatggtgccattatcgcggcctctcccgatctgtcagaagctgccgtacgcctggaggcgctctgggagcatctggggaataatcaggtgctgtcggtaaacagattggtttacttttcattgctgaaaaaattgttccaggcaatgaacctctgccagatccccggacgtgcaggagcactgcttacgacgcttcttcgccatatatcgacaatcaacgggtttgacaatctgatggctcagccgttgttgtcagatgagcccctgacagcgctgatggatcattatcttgatactgatgctctggcagacgggctaccgctgtatgtgtcgctgtaccccacagaagggggcatgcaggatattattgactgcattcgtgctgaactgggtgtcggaaccacgaaaaacgccgtttttcagcatatccagagcctgccccgcggacagcagaaagaggctctgcttgcgtcagccgcgctgcccctgctgttccgtccccgtgaggttcaggggacaatgttcggtgatggtggtatgggaggatggcgaaatatgcagggaaatacccctgtgacgcctctggtcgatgccggatgcaatatggtgattgtgacgcatctgagtgacggttctttatgggatcgccaggcttttccggacaccacaatccttgagatccgtccccggaaaaggctgaaatatgcaggtgatggtggcaacagcggcggtctgctcagttttacatcggcacataccgacgcctggcgtcagcagggctatgaagacacgatgctggcgatggagcatatccggaaaccgctggcagcacgtcaggcactgacccggtcagaggcggtattgcagaaaagcctggatataacggaagaggcagatttggcactgagaaacgcgatggcccggattaaataaagacgccccaaagaaacgccaccgcctgtggtggtgtttttcctgtctggtgttattgaaaatattttcagatatatattatctgggtgatggttaagatgaatttatttaattttgggggaagatacaaaaacaaccagtgaacatatttccggcgggttatccgcaatgctgaaggtcagttgcactggcgatgccggaatacagcttaatacgtggttcgccagtgaagggcttctcagacaataaacctcattcatttcacccatcaggccgcgtcttctccgggagacgcggctttttcatttatatcgcttaatcattcataaggagcaaatcatgagattagccagtcgttttggttatgcgaaccagatacgtcgtgatcgtccgctgacacacgaagaactgatgcgccatgtaccgagtatttttggggaaaaccgacatacctctcgcagtgaacactatgcgtacattcccactatcaccgtcctggaaaatctgcagcaggaaggctttcagccgttctttgcctgccagacccgcgtgcgcgaccagagccgccgggaatacacaaaacacatgctgcgtctgcggcgggccggacagataaccggtcagcatgtccctgaaattattctgctcaactcccatgacggttcatccagctaccagatgttacccggatattttcgtgccatttgtaccaatggactggtctgcggtcagtctctgggagaattgcgtgttccacaccggggaaatgtggtggacagagtcattgaaggggcttacgaggtggtgggcgtttttgaccggatagaggagaagcgtgatgccatgcagtcgctggtcctgccgccaccggcacgccaggcgctggcacaggcggcactgacttaccgttatggtgacgaacatcagcccgtcaccaccgccgacattctgacaccacgacgccgggaggattacggtaaggacctgtggagtgcttatcagaccatccaggagaatatgctgaaaggcgggatttccggtcgcagtgcaaaaggaaaacgtatccatacccgggccattcacagcattgataccgacattaagctcaatcgcgcattgtgggtgatggcagaaacgctgctggagagcatgcgctgatgccgtttcactgaaagtgcagtcctgactcacatctgttcctgccccggggcttcttccattcatttactttttataaggaataacctcatgacaaccgtttcgcataattccaccacaccttctgtttccgtaaccactgcatcagggaataacccacctcagctggttgccactcccgtccctgatgaacagcgcatcagcttctggccgcagcattttggcctcattccacagtgggtgaccctggagccccgtgtcttcggctggatggaccgtctttgcgaagactactgcggtggtatctggaatctgtacaccctgaacaacggcggggcatttatggcacccgaaccggatgacgatgatgacgaaacatgggtactgttcaatgccatgaacggcaaccgcgctgaaatgagcccggaagccgccggtattgctgcctgtctgatgacgtacagtcatcatgcctgtcgtacggagtgttatgccatgacggtccactattaccggctgcgggattacgccctgcagcatccggaatgcagcgccattatgcgcatcattgactgaatggaggcagggacaatgcagcagctttcctttctgcccggagagatgacgcccggcgagcgcagtctcattctgcgggccctgcaaaccctggaccgccatcttcatgaacccggcgtggccttcacctccacccgtgcggcacgggaatggctgattctgaacatggcgggactggagcgggaagagttccgggtgctgtatctgaacaaccagaatcagctgattgccggtgaaaccctcttcaccggcaccatcaaccgtacggaagttcatccccgggaagtgattaaacgcgccctgtaccacaatgccgctgccgtggtgctggcgcacaatcacccgtccggtgaagtcacacccagtaaggcagaccggcttatcaccgaacgtctggtacaggcactgggcctggtggatatccgggtgccggaccatctgatagtcggtggcaaccaggttttctcctttgccgaacatggtctgctttaacccgtcacaaccacatcacacctgttttcacttttatcttctgtcttcagaggtatcacatcatgagaatcatcacccgtggtgaagccatgcgtattcaccaacagcatcctgcatcccgtctttttccgttctgtaccggtaagtatcgctggcacggcagtgctgaagcgtatactggtcgtgaagtgcaggatattcccggcgttcttgccgtgtttgcagaacgccgtaaggacagttttggcccgtatgtccggctgatgagtgtcaccctgaactgatgttccgtcacccgggaaacgagtacgaccagatgacctcagacgccgctgtggatgaggccattctcatcaatgcatacatcttcaccgaaaccggtcagcgcgccggctgacctgtcatcgttaaaccattcttaaccacttttcagagaggattttatcgtgtcagacaaactctccgggataactcatcccgatgacaatcacgaccgcccctggtgggggcttccctgcacagtgaggccctgttttggcgctcgtctggtgcaagagggtaaccgcctgcattaccttgccgaccgcgccggtatcagaggccgcttcagcgacgcagatgcataccatctggaccaggcctttccgctgctgatgaaacaactggaactcatgctcaccagcggtgaactgaatccccgatatcagcataccgtcacgctgaatgcaaaagggctgacctgcgaagccgacaccctcggctcctgtggttacgtttatctggctgtttatccgacaccagcacccgcaaccacctcataaccccgaagctctcacctttagcactaccagttacagagaacttaagatgaaaacattatccgacacacatgtacgggaggtatctcgctgcccgtctcccgtcaccatctggcagacactgctcatccgactgctggaccagcattatggcctcacactgaatgacacaccgtttgccgatgaacgtgtgattgagcagcatattgaggcaggcatttcactgtgtgatgcagttaattttctcgtggaaaaatacgcgctgaaccgccccggttttcctggagagtgttttatctgtgaactcaggctgccagatcatcgtttctgatggaagcataataagctttttctgcttctgccggagggatatgacccagccttcccagcaatcgtcgattgttataccagtccacccacgtgagtgtggccagttccacttctgcacggtttttccagctcttacggtgtattacctccgctttgtaaagaccattgatgctctccgccatcgcgttgtcatacgagtcacctgtactccctgttgatgccagcagttttgcttcttttagtcgctccgtataggccagtgatatatactgagaacctttatcactgtgatggactgtgccggacggccgacgggcccacaacgcctgctccagtgcatccagcacgaatgtcgtttccatagacgatgagactcgccaccccacgatacatccggcaaacacatcaatgatgaacgccacatagacgaagccctgccatgtgctgacgtaagtaaaatcagccacccacagctggtcaggacgttctgccacgaactgacggtttacgcggtcgcctgcggaaacggctttccggctgacggtagtacggacctttttaccccggagaacaccggcaagtcccataaccgccatgaggcgcgccactgtacatctggccaccctgataccttcgcgtaacaactggcgccagactttacgcacaccgtacacctgatgattttcatcgtatacgcgctgtatctctctcttcagccagtcatcgcgctgagcacgggcactgcgtttatcaggatgatgtcgctgttgctgacagtggtaatacgttgacggggcaatatgcagttcactgcataccggtccgaccccgtactgctcatgcagcttatccagcagcggcattattttttccagaggcggtcgaactccgccttcgcaaaataagcggaagcctggcgaaggatatcgttactgcggcgcagttcacgattttcacgttccagctctttcagacgctgacgttcagcggtggtgagtccaccatcaccactcccggtatcccgctcatgctgacgaacccacacacgcagagtctctggtgtacagccaatctttggggcaatggaacaaattgccgcccattgtgagtcatattcgccctgactttccagaaccatacgaactgctcgttgacggacctcgggggaaaaacgtgtatttttagtcatcctgtttacctctttctcagggagtttagtctccaggattcccggggcggttcacgctggtgcgtaccgaccagccgggattcagcacctgtccccgctctcagttaataaacagtattgatatcctccgggctcgccgggcgaccggcctgatgacccgcgacaattacagaacggtaaataacattaccctgggtaagtatccggaggcgaaatgatgaaactggccctgacactggaagccgacagcgttaacgtacaggcactgaacatggggcgcattgtcgttgacgtcgatggtattgagctcgctgaactgattaacatggtctgcgataacggctactcccttcgtgttgttgatgaatctgaccagacctcagcagaatgcacgccaccatttgctacccttaccggcatacgctgcagtaccgcacatatcacggaaacggacaacgcctggctgtactcgctgtcacaccagaccagtgacttcggtgaatcagaatggattcattttaccggtaacggctatctgttgcgtaccgatgcgtggtcgtacccggttctgcggcttaaacgcctgggtctgtcaaaaacgttccgtcgtctggtcgtcacactcatccggcgttatggtgtcagtctcattcatctggatgccagtgccggatgtctgccaggtttacccacttttaattggtaactaggaacaacatgacatcattaaccccggaagcagcactggatattctgattgcgtggctgcaggacaatatcgactgcggatcgggaattatctttgacaacgatgaggataaaacggattcagcagcactgttgccctgtatcgaacaggcccgggaggatgtccgtaccctgcgtcatctgcagcttctgcaccagaaccggtgaagctcactcaccagacttcattcctctgacgccagcctgcacagggctagcgttttcatttatctgcaaaaaggaatatcgattatgtcagatatcacaatctcccgtccggaagtggtcaacgggcatacggacgttatctgctcaaccagcattcgccacattctggctgtacgaaagagtacactgttgcaaatcgacacacttatccgacaactggctgaaatctcggtgctgacggaaagcatcggaggtaaaactgccccggactgggccatgaaacaggattttcgctgcggctgctggctgatggagaaacccgaaacagcaatgaaagccattacccggaatcttgatcgcgaaatctggcgtgacctgatgcaacgttccgggatgctgtcattaatggatacgcaggcccgtgatacatggtaccggtcactggagtacgataattttccggaaatcagcgaagcgaacattctgagcacatttgaacaactgcaccagaataaggatgaggtgtttgagcgaggggtgatcaacgtcttcagagggctgaactggaattacaaaaccaattgcccctgtaaatttggcagtaaaattatcgtcaacaatctggtgagatgggaccggtggggatttcatcttatcaccggacaacaggctgaccgactcgccgatctggaaagaatgttgcacctgttcagcggtaaaccaatccccgacaaccggggaaacatcacccttcgtctggatgatcacattcagtctgttcagggtaaagagagctatgaagatgagatgttcagcatcagatactttaagaagggctccgcgcatatcacgttcagaaaaccagaactggttgacagactgaatgatattatcgcaaaacactatcctgatatgctggcagtatagctttgccagtatgctcaaagatcggaaattgtccgataagatatgatcgcggggcatataaaccggtttcagatggcatacccgatggcatactgtctggaagggaaaataaaaaagcgcatgttaaacaataacatgcgcttataatctggcggtgaggggg

SEQ ID NO: 58 - DNA  (genomic), 40 bp; double-stranded, linear
cgcagtatcaacagccgcaacaaccggttgcaccgcagcc

SEQ ID NO: 59 - DNA  (genomic), 40 bp; double-stranded, linear
tgtgctgtaagggcgttagaaatagagctctgaattattt

SEQ ID NO: 60 - DNA  (genomic), 49795 bp; double-stranded, linear
aagaaaaacaaataaaaatcagtgtaatacgtgaaattgctgaaaagttaatcaaatttaacaccaagaaaaatcaaggtattaggaagttgctcatagctagtataccaagtctttttgccagaaatttttctggattgtctacttgctaaccacgagcggcaaatccagtgttggtgtgatttttgttttacgatcgtaaatcaacacctgattttctgttttatgcccgctgaaaatttgtttgtcgcgactgctgccttcgtaatctgagatccccttggcttttatgtcgtgaaaattgcacccgaacggaacgccaactttttgctcggctgcgcgtttagcctgattccaccagttattcagcgttttagctatgactttcccgcctttggttgtattgatcacatattcgcatgtacaggaagatacatttcgggctaactggatcgctgtacgtaatcgcggtgaccattccttgatttgtttggtgccggttttgttttgctcaatgtagatccctttatccataatatcctgccatttcaactcaagcacatcaccgagtcttgccgcacagagataggaaatctccattgcaatgcgtaactgtggaattgcttccgcatatatcgccgcatactgttcatcggtgatgtaaacagtgcgggctttaagagagaattttttgactcctttgcatgggttattcttcacatacccacgctcatatccccacccgtatactcgactcaggcttgccagttcatgatttgcctgggtcttgctctcaagccctcgtttatccatgaaaattcttacctgctcagttttgacattatcagcaagcacttttccgaataccatcagcaacgccttctgatgttgtcgataatctttttgggttcggggggccagttctgtaaatgcaggggagtccataaacatgtgccacaatttagctacggtcattatgttgtggagttttgctttttccagttcataattttgccagactttagctacgctggttttccgcactcttcctagccctatacttcttgtacttccttcgggtttccacacgtaactgtaaccattcgatctaacccgcggtggcagtacattatcttttttattttttcttggtcttcccattgttcagcgcctcaaaatcgggttcagcagaaaccagttcagatgtttttggcatcgttgtcagaccgtgtggaatatccctgcggagaactatgggttcgtttttagggccgattacaaatgggatgccgtgcagtcttaactggtgttgctgttttgtgtatcgctcgtatttcgtgatctctttaatctctgctggagatagagttaattcgtacatgtggtcacgtgcctttacagcatgaccgcggccactatagctggtgggcggcgatatgggttgaacatcaaaaatcagcctgactcgggagcagtttttgccagatggctgaaacgtatttcgcctggtaacgtgcatcgtgcagggcgttatggcgttcaccttcgaatggaatagtcgttcttgcgtcgaaatccatcaccagtcccagagcaaccatcgttcttacatcgcgatcattggtgtaacgccacgggcaggggatcccctgccgttcatatgaacggcgtaaaatcacgttgtcgaaagttgcaccgttaccccagacctgaacaaaaaattcaccggagttttcgtcgataaattcccggaattgcagcagtgcatcatccaacgtgatttcatcggtcagaatggaggattgtgcttcgcgtgactgtttcagccaccacttaatggtgtcccgatcgatgaccccacctgcggtttccagatcgatagttttgctgaattctggccccatctctccggttgccggatcaaaaaacttaccggctatagagtttattggcgcatcaggattttttcccattgtttcaaggtcaatcatcagatggtgccacaacctgctggtggatgagatttcatgatgaccgttcactttaattaagggatttgctgtttcgccagttttattatcgctggcgtgatactgatcgctgccagtgttctccttgtgcagatgttcagtgccttccatttcctccggatcatttttctgagcttcagcctgattctcttcatcgaatgtttccaggtaggttgcgttccccatcaccgcaccacagtcaggacagttgccgccaccggtctgaccgcatgcggtgcaaactttttccagttcctgttgcactgctggttctggttgttgttcttctggcccgttttgttgcgtatccgggctgttttgttccgcttctggctcattttgtttcacgttgggctgattctggtcctcagcgtcgcgactctggatccctttcacccatttcggatcattcgggtcgctaatcccttcaacaaattcaccacgtgatgcagcaagcaatttatcggcgtcaggctggctgatattggctgcctgcataattttgtttacttcgtcagcggtaacttttaccggctctgattgttcggaatcttcagcggtatccacattttgcggtaagcccgtgtatgtgccattttttcgggcaaaatattcttcttttgagatttcggtaccgccggcagccagcgccttgtccagaccagaaagtttgtttgccctgccgtatttttccccgcccttatcggtaaagacgaaataaaatggtccttcacgctctacagatggttcagcttccaccaggatttcatttttttgagtatcggattctgccgtctccactggagcagtttgtgctgctgacggctggagagcatcagtagagctctggtctgtttcttcatgttcaaacacgccctttgtcgtcaggtattcactgatatatttgttcagtgcaacgggatctttgtgaatatcgatcggacgttcgcgaacaaggccaaaaatagtctgacggtcatagccaagtgcttcgggctgtttgcgcattgatgctgagatacgcttccagtcttcgcgatccttgtcgataacctcatttgtcgcccagcgatggatggtaccgtcaatgtttcctgcatccacatcaccgggccagagggcgcaggccagttcattgtcgagtgttttccatgtctgtttgtattcgcggcgaatggcaacagtgacagccccggttttttcagcagcgttttcagtgttctgttggttgactctggcgcgggtgagatcaacaacagacgtgtattttccggtttccttgcgttcaccttcgcgacgttttttccagatgcgcatctctgcctgaatttcaggccatttagcgccaggctcacatttatgcttaacccacccgatggcatgcagtttaagttcaggatacatggcgttaacttctggcattttcatcaacgcttcaacgatatgtccgccgaatgttgccatgtcttcctgtagtaattcctgtgcgctaatcaccatatcaacggtgatgttttcgcatgtgtcgaatttaaccaggactgcgttctgtacttcaggggacagcttgtcaaaattgacgttcatcggatcggattctggttcgaccggtacaaaggaagctgactcctcatcccagcggttttcctgcatatattcggtatcccaggaatcgagggcagggcggggtatgccgggtttatcctcgcagacaataaatttataagcgcagtcctgagctgccgggaattgctccagaaattgccagtgaaattttgcgcgtgcgcgacgctcatcaccggcttcaatggcagtggccaccgcaacagcgctatcttcttttatggcctgttcgtcaggaatagcagcgcaaataaagattttactcattgtgttttaacctcattacagatttaagggtgaacaaatccctgccattgctggcatataaaaatgaaaccggatattaattacggtgctgttttaaagtcctgccggtatttcgttattattagtgtgagtagttttatctaccggataacagttaccgggaattttttgttctgctgctgcagccatgcattctttcattgaaccgtataagccagtcaccagctcaagagattcgccggaaacaagataaactgtcagaacgagtgcaaatgttgtattcattgtttatatcctttttgcagcaggtccagacgagccagcattgaaggaatgcatacttcatttaacaggtcctgctcgagttttctctgcttaatggcgtcttcaataaatgttttgtctccagtgataacgccaatttcgaaacgaagttcagacgtgctggcattacatgataacttttccattatcgcgtcctcaacaatgaattttgtgatgcggtgcctggtgcctccaggtgacgttaaccagttaacaattaacgccggatacagagcattctcgttactcagcaaatgaccgctttaccgatttaactgttccgcgtgcgctgagccgcattcaccgcatcacaaaattcacttttaaaaaagggcggcagagcagttacggagtaaaactgataccgccaaatgtcaccggaatattgataacagagggcgttgcagcggggttgtcacttaagcgtatggtcaacctgacaacccggtgtcctcaacgggggaaagaataaccccgccatacttaccgccgcgccatttcgcggattgccacaaccggaagcgcacggtcgaattaaatttaacgacggctctaagggagaaggacttcgccgtgcactttcgtgttatgccctgacttttcagggatatatcctttcagtaaactgtcagtgccggattcttatctgtgtccggcgcacgaccacacntagcagcgtgttggtctccatttttaattcagcccttaatggaggataaaatgccaaacaaaccatgccctgcctgtaacgctctttctggctttttagagaagggcggttattacatttttaactgtccagaacatgttgaatttcatatatcaaaacttgacagtatcattacaaagccaaatcagtatcagtctgatttactgaataaagagttaaacgccgcccgagattaagggcgtagtggcccattaaaaatattgcaaagaccaactattgttgaactggattaaaccagtaattctctattgctcttattgttaccatcggatgattgccgggggttattttaagttcgggaggaaaaggctctccatcagcagccatcattgagtatgtgaaatccgccgacgcagtccctttcatgataattccgaatttttcaagtaatgagagcagttccggtaatcctgtgtcatctgaataactttcctcatagaaagaagcgattgccgcaggagatgacagttctcgctctgcaatttttttgtagttttccagaattctttttttgaatacttttcctcgacatgaaaacccatcaccgaggcaatccgctttgcagtttcttcagtattctggttgtttgttaccgaaacagagtacaatccggtaaacgcatcgcgcacattacgagccatattatcaatgtatttcttcgttgcagattctaattcaacttcgttcagacgttggtgaagtgcatgtgctgcaatttcctggatttcttttagtaaatctttaaattccatctttaactccgttagtcgttagattttgccgaactggaaagcgcctgtttaaactcactgaagctgagagcttcctcgccttcggcaaggccttcgaagtattcttcgtaagccttttccatgattgtgtcgaaatccatatcactcacctgagtttctttccagccagcgacgggcaccattttcggttttaaacgttttgcttttggtatacgtcatcgcggtgaatgtaccgtcctggttgggaaacacgccgtacaccagagattcgttgttgccaagatcgatagtatccatgttgacctcatttccccttaacgccgggtagcggaacaaaaacctgctgcatagttattaaagttgaaccctgccgtcatgttcatacgcctcgggctggctacttaccccctgaccactgcttggtaactcgaagtattgcccggcgttctgtggggcggggtgggtggttggtgtatgtaatctacaataaaaaactgtttttgtgtcaacagtttttaattgttgttttgggcaaaaaaatccctcgaaagagggagtatgaaaattgttcaactcagatagagaagggaaattgtcgccgagaatgtgtcacgcttacaatctcaatgcttgaagcagctactctgtacaggattatgtagttagggtgggtcacgatctctctcaatccagaaacccgttcgcttggtggatataagtacggatgctcagatagaggtaataccgatgtttcaatgcgtatttttagtctacgtgctgccggtgggttctccttggcgatgtaagttatgatctggcgcaaatcatcgcgagcagacggtagccataaaatgggtaacattactcgctcttgttagttacagcaatttgagcaataagattttccatttcagccattacctcgtcatgtggaattgcggggcgagtgtctgcaaggcttgacgttactttagtgcgcaaccattcgttgtaactgttttcttgttcggtagtttcgaattctgaaactatcggagaaagggctgtacccatggcataactcctcttcttgtactgtggtcacgcccggcggcttttttgtgccgccagccacctagcaatggtttcttccattgattttttcttgtctttgatttcttgaagcattttttcttggtcttcctcaggaaacgcactaaaagcttggagcagttcgcgttggcgaggaccaattttcatcgtgtcaggggtgaaaatttgctcacactcttcaggaggcaataaaaaccaatgcaatggatgccctgaaacctcaaccagtttatccaaacttgaggctttaggtgtagccttaccgctgacccattgttgaacagtttgttgtgtcacaccaattctacgggcaagctcagcctggctccatccagtttcctgaagaagcttgctgattctgtacatagatacttctagggcgctcatcattattcaattttacaggtaaatactgttaaaagcatcacaataaaaaactgttgattgcatacagttttttattgtaggctttgcttatagtttttagaggagggcaaaatgctagatagcactcgcgaaaaaattaggcagaaatacactcaggctgaaataggtcgttatatgggggtcgctcaacagactgtttggcaatggtttagctttggcgttcccccaaagcaggtaattccgttatgccaactaatgaagtgggaagttaccccgcatgaaatccgcccagatatttatcctaacccaaccgacggtttacctgttggatgtaaggttaacacatcaaatgcgccggagttgattcatgaaaatcaagcatgaacacatccgcatggcgatgaatgcctgggcgcatccggacggcgaaaaagtaccggctgcgaaaattaccaaagcgtatttcgagctgggaatgacgttcccggaactgtatgacgacagccatccggaagccatggctcgcaatactcagaaaattttccgctgggtggagaaagacactcctgatgcggttaaaaaaattcaggcgttgttaccagcgatcgaaaaagcgatgccgcctccgctggtggcccgaatgcgcagccacagttccgcttattttcgggagttggtagagacgaaggaacggctggtgaaagatattgatgatttcgttgcatcagcgatcgttctgttcgatcagatgaatcgtggtggcccggcaggaaacactctggctgtgcattaattgggtaataaatatgagtaatgacaaaaaattgacactgagcgtttacgaaaacagtccgcacatctggcgtggcggtttatctgatgtggagctggcagagtggttgatacataaagctaatgcgctgctctggcgtttgtcagccagagaacagcgcaaggaaaccagaataaagctggctgatgcagaagcgtgtgccgggcttattgaggattatacaaatcttggtatttcttcagcagagagtgatcccattcagcctctgagcagggagtcaatccagcacgctggttgtatggcacatcttgtaactgctcgtcaacatgaggtgggtattggatcacttccggcgggatattcgctgattccagagctggttgaagcaagaaaatcagttcagaaaaagagagatgacgcacttcaattattgagagagcactatggcgcgataccagaatgcgaacagcgtcgataccctgaaggttatgaatggatgcagtctctttttgaagttcgctaatcaatatgtcgagacgaaggtatgtttcggcgcgcagccaggctctgtaatccgggagcatttcggggctgttacaccagcggtttgttgctgcaacatttaatacatgagcctgataaaggcttttcaaaaaatacatgtcgaacctcctctggttctgtcgattgggaaccacagattatatccggaggaaggttcggcaccagatgaggtagccatgcgtgattacgcaaaagtttctccgcgattctggctgggagaaacggggagagaacttagaaaggcgggtgcagaagcgcaagttgttgctttttacctgatgacatcccctcacgcaaatatgctgggtttgtattacctgccagttttataccttgctcatgaaaccgggcttggtctggaaggggcttcaaaggggcttaaaagggctgttgaagctggtttttgtagctatgaccatgatgcagagatggtctgggtccatgaaatggcagcctggcaggttggggaaacgttgaagcctggcgataaccgttgtgcaggtgtcaggaatgagtatgcatcattacctgaaaacgcttttctgtcagtgttttacgacagatataaaacggatttccatctggatgtgaggcggaataatagccgaaattcggtaaggggcttcgaaggggcttttaaggggcttcgaagccaagaacaggaacaggagcaggagaaagaacaggaacaggacaaaaacactatggttcatggcaaaaaaaacaccacgaaccaggcaggggatgttcagaccgtcaatcctggtcagccagcaggcacgacaccggaagccgattcgggcgctgtgcagcaggtgatgaccgcagggtcggagcaatcacaccaactgcagcagcctgaagccgattccgccattcagcgggaagccgatcgggtagtcccggaaagcaccgggcagtctgtgggacgagtggattatccggatgtgttcgaacaggtctggcgggaatacccgttgcgtgctggggcaaacccgaagaaatccgctttcagtgcctggaaggccagattgcgcgagggggtgccaccagagaccatgctggatggtgtgaggcgttacgcgagatacctggcggcgaccgggaaagcgggaacggaatttgttcagcgagcgacgacgttttttgggccggaccggaattttgaaaacccctggttgctcccggtaagcggcacgaacaaccagcgttgtgtgaatcatatttctgaaccggataccgaaattccgccgggattcagggggtgatgtggcatgaaaaacattgcggcagccggggttcttgaacgtattcgcagacttgcaccacaggcgtcggttccaccgtaccggacggtggaggagtggcgggaatggcaacttgctgaaggacgaaaacgcagcgaggagattaaccgccagaatcaccagttgcgggtggaaaaaatcctgaatcgttcgggcatccagcctctgcacagcaaatgctcgtttgcgaattatcaggtgcagaacgacgggcaaaaatacgcgctgagccaggccaaatccatagctgacgaactgatgaccgggtgcacgaattttgtgttcagcggtaaaaccggcaccgggaaaaatcaccttgcagcggcgatgggtaaccggctgatggcgaaggggcgcagcgtgattatcgtcaccgtgtctgatgtcatgagcgtgttgcatgacagctacgacaacggcaaatccggggaaaaatttttacaggagctttgcagtgttgatttgctggtcctggatgaaataggcgttcagcgggagacgaaaaacgagcaggtggtattacaccagataattgatcgccggacagcatcactgtgcagtgtcgggatgttaacaaacctgaatcatgccgcaatgagtacacttcttggtgagaggattatggaccgcatgaccatgaacggtggtcgatgggtgacgtttaactgggatagctggcgtccaaatgtcagcaatatgagggttgtgaagtaattttgtccggaggaaattttaatggaaaccgtatctgacgcactgaaagcactgaaaaaagcctcttcacatgtggtggcagctcgccttggaatcagtcgtgaagaggctgtcaacgagctgtgggaactcaaaataaatggcgtcgttgataaaactggtcacacctggtttctggctggcgaaggtgaatcccgggtaaccgaagagcggccagtaaaatctgaagcacaggatatgctgaccggggaggtcgaacaaaaagttaccgcagacatgatgattgagtttatcggtcaggatggggctaaaacgtgtgaggaactggcgggtaagttcggtgtcagtactcgcaaggttgcttccacgctggcggtggtaaccgcaacggggcggctggcacgcgttaatcagaacggtaaatttcgttactgcatgccgggcgataatttaccagcagagccgaaagccgcgctggtaacggaaagtgatggtaaggcctttcctcagccagcaggtgctgcgttaccagtccgggaagccgcaacacaggaagaaattaaaacagaaactgtggcggacattgtgcagccgttgccatcgtttaccgaaacgcaagcagatgagctgatttttccgtcccttcgcagggcaaacctggcgctgcgcagggcgaaaagtgatgttcagaagtgggagcgagtctgcgccgcgctgcgggagctgaacaagcaccgggatattgttcgacagattactgattcttcccgccgtgttgtatcggaaaagtgattgccggaggcgcttatggcaaaagtatttacacaggaagagcgggaaaaaattaaagggcaggttgttgagctagtacgccggagtgggcgcgagacgttacggcaactggaagccaagacaggtgcgacaagatatctgatgagcgttcttgccagagagctggttgccagtggcgatgtatacaactctggttacgggttattcccatctgaacaggctcgtaaggactggcaaaacgcccgcaaaaaactatcgagggcaaaactgaagaaaccggttgtggttgatcctgaccttatctggtcattaccagacggagaaatacgccgctatgacaggcaattgaacataatttgtagtgagtgccgtaacagtgaagtgatgcagcgagttttgatattttacacaggagtaatgatggaatagtgaaaataacatgaaacctttggattctggtgtttcagtggatgggaaaagagcagatacatagaaaatgaatagcaataattcacagtctggatgttgtttgtatgcttataaaatgatcctagtatgcattgccggagttgaatcagctccaatgaagaaactgagaggagtatttagaagatagctaaatggatgtaattattagtatctaaaaaatagtatttttgaaatgggtctaagaacacaacaatgtacaaatgagaagttatcttttaatatgttcaaagacccattaggattgatatcagttatgttagctagattgataaagtgattacatattttctgttatatgctgaaatgaataatgctattccagagtgcagcagagaaagtctcctgatgattgagctctggaaattgtacaatagaaaaattactgtatttttctgtcaaaatatttctcaaaacagattccgctttgatggcttcaggatataaagatgcggagtaatcaaggctaagatttccgttaagcaagcatatacttttagtgtgctttgattctgatatatcatctttaattatcttgatgattctttcattctgccatagaagtgatggtgcagatatataataatagttaaagcatgaattattttttaagcaatcaagcacaaaaatagcacctagcgagtgtccccatataccgattctggaactgttcggagcaatagtactaacccatggcatgatctgagttagtaataattctcggaaagactggcttcctccaccagtaaagtagatccatgctggtttagagttatcaacaatagcattttcaccatcaggagtataatcgtaagcacggcgatgaatgctaaggttattccaagattcataaccaagtgtaactaacactggtggattgggtagtgcatcaataacaggcagaatatcagaaatgtaattgttggcactattcccatcaagtatataaagagttgcattattttttttaatgttttttggagtaaaaatacatattttatatttggtgtcatggttaattgagttaaatatgcgtgtttgacaatgaatgtccatatgtttagtcatgcgttctccccatgagcattaaaggatgcttaagatatgctatgtcactgataaaaaatttgttgtgtgtgtttagttattttatctacctccattatgatttaagactgatatatgttatcagcaaaggtacatcgttattattttacctgtcaatacatttgatattgattatcgtttacatcgcttgcttaggaaattgaaggcaggtaactatcatgtcaatgaactaacccacagtctaacgtacttctttccccaatcaccaacaaccaaattcctgttatcaccactgggattttggcgcaacttcatggtgcagaggtaaatagcatcaagcaaaatctctttttccgttgttgtccttatgggacgtctgtctttctgaccgatttcatattggcgaggtaatgggaagttaagtagaatagctgcgggtgcttgaggctatctgcctcgggcatgaacaccaacggcagatagagaaaagccccagttaacattacgcgtcctgcaagacgcctaacattaatctgaggctcaatctatgaacggcaaatctaggttagcctcttacgtgccgaaaggcaaggagaagcaggctatgaagcagcaaaaggcgatgttaatcgccctgatcgtcatctgtttaaccgtcatagtgacggcactggtaacgaggaaagacctctgcgaggtacgagtccgaaccggccagacggaggtcgctgtcttcacagcttacgaacctgaggagtaagagacctggcgggggagaaatccctcgccacctctgatgaatcaggcatcctcaacgcacccgcacttaacccgcttcggcgggttttgttttttcctggcattctggtttacaattcgcacgccagcctgaacaactggcacctgctgcgccagcagagacaaccgatggcgcacgataccaaattatacaattctgatgattctgccgtctttgccagcaggcgcggacggtgttttcacgcattcaaatctgactggtaccagcatcccccatgcactgaagaacaggccgaatggctcattcagtgttaccgcaggcgcggatgcgaggttaaaaaagcccttagcctcgactaccgtcactggataatctccgtcaggctcccttactccgaacggccaccgcgtccgtcccgcacattccagcaacggatctggaggtaatgtgcgggtattacttcgacctgttctggtaccggaactcggtctggttatcgttaagccaggccgtgaatcaatgtcagcattccataacggcagaatactggtggagccggaaccaaaaagcatgcgagctctgccgtccggggttgtacctgccgttcaccagccgctggcggaagataaatcactactgccatttttcagcgatgagcgggtgatccgtgctgcgggtggcgctggtgcactgtctgactggttattacgtcacgtgaaatcctgccagtggcctcatggtgattatcatcacagcgaaactgtcatacatcgttacggtaccggcgcgatggtgttgtgctggcactgcgacaaccagctgcgcgaccagacatccgaatcacttgagcaacttgctcaacagaatctggccgcctggatgattgacgtcatccgccacgcaatgaatggcatacaggaacgggaattatcgctggctgaattatcctggtgggcagtctgcaatcaggtggtggacgcattacctgaggcagtatcgcgtcgttctctgggattaccggcggaaaaaatccgctccgtataccgtgaaagcgacatcataccgggagaacagaccgccaccagcatactgaagcagcgcacaaaaaatattgcgctaccgcctcacacccaccagcaacagaacccaccacaggaaaagacggtggtcagcattgccgttgatccggagtctccgaaatccttcatgaaacgacctaaacgtcgccgctgggtaaatgagaaatacacacgctgggtaaagacacagccgtgtgcgtgttgtggtaagccagcggacgatcctcatcatctgattggtcatggtcagggcggaatgggaacaaaatcccacgatattttcacgctaccgctgtgtcgggagcatcacaacgagcttcatgcggatccgctggcgttcgaagaaaagcatggttcccaggttgatttaatttttcgttttcttgatcacgcctttgcaaccggcgtgctcgggtaaaagaggttactgatgcgtatagagtttgttttgccttacccgccgacggtgaacacctactggcgacgtcgtggcagcacatattttgtatcaaaagccggtgagcgttatcgccgggctgtggcgcttattgttcgccagcagcggctgaaattaagcctgtccggacggctggcaataaaaattattgcagaaccaccggataagcgccgccgtgacctggacaacattctgaaagcaccgctggatgcgctgacgcatgcggaagtgctcattgatgacgagcagtttgatgaaatcaatattgtgcgcggtcagcctgtgccaggtggacggctgggcgtgaagatttacgaaatcagaggtggtaacgatggcgcgtgatatccagatggttcttgagcgatggggggcatgggcagcaaataatcatgaagatgtaacatggccctcgatagctgctggttttaaaggattaatcccgactaaagtgaaatcacgtcctaagtgttctgatgatgacgccatgataatttgtggttgtatggcacgattaaacaagaataatcagtatttgcacgatttgttggtggattattacgtaggtggaatgacatttatggctcttgcacgtaagcatagatgttctgatgggcttattggtaaaaggctttataaagcggaaggtattattgaaggaatgcttatggctctgaatgtccggttagatatggatatgcggtagggatatatagtgatgagggttatgttttctgtgtttataattaacatgtttattttttgatggtcatgtattgtggaaggtagataaaatgttgcctggtgaattgaaaatattgataatcaatcttcatcattaaataaaaggagtgcttatgtggattgtgttagtactgtcactgtcaactctcagttggcataaggtagtggctttttcattgttgacggtgtctgttgtcctggctgtgcttaatgatattattgattggtcggtgttattttttgttgctacaatcgttttttttattattttgaagttcaactggaaatataacgcctgggctaaatctatatatgaagttggcatagttttatcagccatagcattatttttccatctatggccagggtttcacaatcctgtagtgctaaattctgttactgttggccctcaaagtactccctatacaatgtattttaattttgataaagcgctggtgccatttttgttagtcctgtgtacatcttctttgtttaaaaaagaagtaaaatcagaagtgtctttgtggaagtggggggctctgtcgctctctgttcctcttatcctgtttttggctgttttttttggtggattaaagccagagattcattttcctgagtggttgccagagtttatattggctaatttgttttttgtgtctctggcagaggaatcattatttagagggtatattcaatcacggctatcagaagtaacgtctccattggttgcattaattgtggcggctttgttgtttggtttttatcactattcaggtggtgctttacttgtattatttgccacgttatctggtgttgtgtatggattgtcatggatgtggagtgggcgtttgtgggttgccacccttttccattttggtttgaatctgtgtcacttgttattctttacctatccatttttaaaacataattgattttttctatggttttaaatttataagactgaaaaatagcaggacgtgacatttgcatgaaaaatatgcacggcaaagcatttacgtacgtaaaaaatcaggtatgctgttaagagtggttatttcgccgcatagcttgaccccgcctctgagcgggttttttgtgcccgcaaagtagcgcagtgcgttaaatgtgctggtagttattaatacaggtctttcagcttgctggctttttcgacaagagttattggtgtgtcacgttaaccggaaagggtaaaaagacatgctgaaacagcaggatatgacagaaaccgccagagttgtgtttgatgaattaagcgtcaccgaaccggcgacggtcggggagattgcgcagaatacgtacctttcacgcgagcgctgccagttaatactgacccagctggttatgcgggtctggcagactatcagttcggttgttacagacgccttcagtcctgaaggcttttttatttgtggtaaatgggcggctggtgggtgttagcggcacctgtcagtcctttgcttatgtgttgatgataatttaccttttggggctataattgaactaaccaattgctaatgaaagtaaaattataatggttgttgtctgttcagttatcatggtttgctccccaattaatatttttcttgaaaaggatacgttgtcacttaagcccggctcagtcgttctggccaccaaatgcatcagggcgcttttccttatgcattatggcaaagttaaaattttcgatataaaccattccatagtaagtcaatatctggaaattcagcataagctgacaagaactcatctgactgacgttccgctttatctgtcactggaacccaacaaccctgcgttggctgaggctttaattaccagccagagattttccggagataccacggatatgtttcttatgatggcatgcctgtcgctgtttgaatcagatgaacggatattattatttttaagtggatgtttatccagtataagtgccaaagtcagggcgataattcagacagatatatcagcaagctggacgcttggtgcgattgcgttacgcctgcatatgagtgagagtttgttaaagataaaactgaaaaatgaagggcacatgttcagtcgcttgttgctggaagagcggatgcgtgttgctgtcaatatgttatgttcccggcatggatatggacaggctgtagcagaaaaatgcggttattcaagctggtcctactttatttctgtatttcaccgctattatggcttcccgccagacagatatgtatccaggcaagggcttgattattgattttcatctgattattattttttgacccagccctttagctcagtggtgagagcgagcgactcataatcgccaggtcgctggttcaaatccagcaagggccaccatcacataccgccattagctcatcaggaaagagcgccagctttcgaagctggttgcgcggagttcgggtccccgaaggcggtccattatctgtatcctgcgttgttagctcagccggacagagcaattgccttctaagcaatcggtcactggttcgaatccagtacaacgcgccacacttattttccctggctcgcttttgcgggccttttttttaaatgtctcacaattcaggcggttgactgttgtctggtttgcggggagtttgttaaaagaaactggcatggtgaatccccctgtgcggaggggcaatcagcgagtaggtatatgggataatcgcggattcaggtgctggtactgaattcaccgggaggcacccggcaccatgcaatggcacatagcgccactctccagcccctctccggaggggctttcttatggacaaaaaaagcccgcgcagggagacgcgggcggcaaggaataaacaacaaaacgtgaagtaatatttcagctggcgaataatatccgacagtaatcactctgcgcaatagcgcggcctttttcgtattgcgggctgttgtctctcttctgccattgtcctgtaacttccggacttcagcccgctcctcattttactcacaatattatcccggccgggaggattcatggcatttaaacactatgatgttgtcagggcggcgtcgccgtcagaccttgcggaaaagctgacacacaaactgaaagagggctggcagccatacggcggaccggttgccattacgccgtacacactgatgcaggcggtggctattgaaggagatccacaggtcggcccttcatctaagccggactggttctacgtggttgtgcttgccggacagtccaacggcatggcctacggtgaagggcttccgttaccggattcttacgatgctccggatccgcgcattaaacagctggcgcgccgcagcacggtaactccgggtggagagagttgtacgtataacgacatcattccggccgaccactgcctgcatgatgtgcaggatatgagtacgctgaatcatccgaaggcagacctgagcaaagggcagtacggctgtgtcggccagggcttacatattgccaaaaaactgcttccgtatatcccgaataacgcggggatcctgctggtaccatgctgtcgtggtggttctgcattcacccagggcgctgaggggacattcagtgcggacacgggggccagccaggattcggcacgctggggtgtgggtaaaccgttatatcaggacctgattgcgcgcactaaagctgcattacagaagaacccgaaaaatgtgttgctggcggtgtgctggatgcagggagagtttgacatgagcgccgccacccacgcacagcaacctgcgctgtttacagccatgctgacacagtttcgtgctgacctctccgtgtttaacgcgcagtgccatggtggcagtgctgcagatgtgccgtggatttgtggtgatacgacgtattactggaaaaatacatacgctacccagtacgacaccgtgtacggcgggtataaaaacagggagagtgagggcgtttattttgtgcccttcatgacagacggtaacggcgtcaataccgccactaacgcgccggcagaagatccggatattccggcatcaggatattacggtgcggcatcgagaacgaatggaaaccaggtatcatcaaaccgcccgacacatttcagttcatgggcgcgcaggagcattattccggatcgtctggcaaccgctattctgaacgcagccgggcgcacctccgccttcatcagtggtaaggcaccggaaatcaaaccctcgcccggcggcaacacgccatcgggtccgtctgcagatacgtccgttcgcacaatctccctgctgccggcagccggagaggctgctgcgcagggctggagcattaaggatggcggaattcagttgtcagatggtgtatttaagatcaccaggcagagcaataaaacctggtccctgacgcatccggtggatgacgcaattaccctgctgacacagggcggcagactgaactgtaagttccgcctgtcaggcgcactgaccaacaatcagttcgggctggggatttatctgtatacggatgctcccgttcctgatggtgtggcgatgacgggtaccggtaatccgttcctgatgtcgtacttcactcagaccactgacggcagagtgaatctgatgcatcacaggaaagccggaaacacgaagctgggggagttcggcgattacggtaacgactggcagacgctggagctggtgttcaccgccggcagtgccacggttactccgaaactgaatggagtggctggcccggcattccaggttataaaagacagtctgacactgggactgaatgcgctgacgctgacggatgttacaaaaaatgcagcgtatggcgttgagatagaaagtctggtgctggagataaatgcaccggcagcataataaaaaaagagccagcgactgacctgaaagaagacgctggctaaaaggccttatatgtttgtagagacttatttttcacagacagcaatgatgcctgtcaatatattatcaatatgcggattgaaccgccccggaaatcctggagactaaactccctgagaaagaggtaaacaggatgactaaaaatactcgtttttcccccgaagtccgtcagcgggcgattcgtatggttctggaaagtcaggatgaatatgactcacagtgggcggcaatttgttccattgccccaaagattggctgtacgccggagactctgcgtgtctgggttcgccagcatgagcgggataccgggggcggtgatggtgggctcaccagcgctgaacgtcagcgtctgaaagagctggaacgtgaaaatcgtgaactgcgccgcagcaacgatatccttcgccaggcttccgcttattttgcgaaggcggagttcgaccgcctctggaaaaaatgatgccactgctggataagctgcgtgagcagtacngggtcggaccngtatgcagcgaactgcatattgccccgtcaacgtattaccattgtctgcaacagcgacatcatccggataaacgcagtgcccgtgcgcagcacgacgactggctgaagagagagatacagcgcgtatncgatgaanatcatcaggtgtacggtgtgcgtaaagtctggcgtcagttgttacgggaaggaatcagggtggccagatgtacagtggcacgtctcatggcggttatgggacttgccggtgttctccggggtaaatgggcccgtcgtccgtctggcaccatccatcacagcgataaaggctctcagtatgtgtcactggcctatacggagcgactaaaagaagccggattactggcatcaacagggagtacaggcgactcgtatgacaacgcgatggctgagagcatcaatggtctttacaaagcggaggtaatacaccgtaagagctggaaaaaccgtgcagaagtggaactggccacactaacgtgggtggactggtataacaatcgacgattgctgggaaggctgggccatactcctccggcagaagcagaaaaagcttattatgcttccatcggaaacgatgatctggcagcctgagttcacagataaaacactctccaggaaacccggggcggttcattaattaatgaaaaatattctcaatttgtacccaacaaagacaaacacgaccagagcacctgttcagacaggtttacttaaacgacttatatatgacacaaaaagcgaccactaaagtcgctttttcttatggtaacaggcaataacgctctcagatattttttagcatttttttgaccgcgcgtttccggacgtattctgttctcctgtccctttatatcgtcggaatacccgccgctcttcaaatcccattcccaactcagaatgtagtctgttgaccgcttgttttatttcggtcaggttcaccggtgaaaccggagtccggcgcgccttacgcaaacactctgctcgtttctgtgccgccacttttcttttctggtcatcacttagctgtaccatcacttttgcccatcgttcagctgctctccggtacagtccttttttctccagacattctgccacgtgatcatgtagcataagtgacctccgattatctacagactgccatcctgaatttaccttcccttaatgaaataacaataaaaaacaaaccacgcaaaaacaataaaacaacacacaaaaaaaactaaataataaacaaaaataatcaccttattttattattttttgagggagcaattactgaacaaaaaacgctgactatatactcaaaaccaaacaactattctgccaatcaggtatcatggcaacacacggaattaccgtgtttttgccttctctgcccatacaatacgggcatatacttcattctctattgtaatatttctatccatgtgccccactccatttacctgtaaataatattcaaaatatttatcacagaaatcgtttttggccatgaactgagcacactataaagtccggaactgactctttgttaaattaccttaacgttaccagtaacaccctcataacaaaacatcacggtatacactgggtacggatatattcctgtgctccttccagttgcttctgcattgccatcagccgttctctgaggatgaaataatcccgttcagcggtgtctgccagtcgggggccggttgcattatccacgccggaggtgccggtggcttcacgcacggtaccggagcaggtggcgttgatccgcaggcgcttacgaccagcggcaacatcagcacgcagagtttcattttcagctctcgcatcggctaattccctcgagtatctggcatcaagtgcagcgacatcacgctggcgtatctgcatatcagtaattgtcgcgttcgccagctccagctcactggcttttttatcgcgctgctctttgtagatgatggcgtgatcacggtaatgattcagccccagactaagcgcaccacaggccaccagcaggacaatgataaccacacacagaacacggttcatatcaccaccaacggattgcccagaccagaacagcaatggccacaatacgaatggcaaaagctgccgctcttgttaaatccagactggctggcgtctccacttcaatgcctttcataatggacaacctcagaaagaatcttttatacttcctcacagggaaagtacctccctacccataatttctcccttgccttactcaaggtcagaaaacacaaaaccccgcttgctgccaacaaacggggtttttacttttattcacttaggttttaccagttttcaggatttcgtgttatccacccgcgttggccaacgtcatttttcaggaaaatattctgctatctgtcgatgtcccagcacgccagcgcgctctcctggtcacgccgtgagacctgaccgtagcaattatttgaacggatacggcagtctctgccaccgtccttaatccaccagcgaatcgcctcacaggcaccttttcgatcgcctgcattaattcgtttataaaacgtcgacgggaacacttaccggggccaatgttgtacggacagaatgacgcgatccccgctttctggggttcggtcagcggcacccggatgtttttctccacccatgccagcgccttgtcacgttcgatggcattaacccggtcgcatttttcctttgacagcttcatgccaggaataacaggcttaccatcccaccggaatggcaccacggcagatggtcnagatccccgcaccatcacggtatgccgtggtgtggttaccttccttttcatccagaaactggtcgaggatttcaggcgcagaagcacctgcaccaatcagcgccagaacggcagccgacaggccgtattttattttttcgttcatggggatttatcgatttctaatcccttgatatgttaggtatataatccaacactcatggtcgctctcataaacatatcccttgagacgcagcagattacaacaaatgaagccatataaatgaacagtaaagaaagtttgcgcagaagatttttacaactaatgacagaaaacgttaaatcagagttacttcttctgatggcagataataacgaagcaacaagcagcattcttgcagacccttacggtaagatctcacataaaacgctggatattattaccacaacattaacaccgctgatgcttcaacggctgaaacataatatcaacgcatgggttaatgaagaattaagtcctccctgcttatgggattctcgttacgcatgtcagcaaaaaatgcgaattttcaacttactatcaccaaagctcaggtagccataaaatcctgcccttcatggcatacaggatttcaatggaatcacaatgaccaactcttgcacagctgtatccctgactccccgacaactcagattttcagtatctgctgctatctaaagagaaagcgcacaaatgcaagggtctttcatcacgtcctgttattgattgcctgtgaccttttcttacctcatggaacgttttttcagttagaaatattcattttacaaccagttcgtattgtttattcatcgactactctccccgcgccaccttacgacggtcctctctgattttgaaatacaggttagtcagatacgtcagcaggccaaacagcagacttcccagcactcctattgccacccactgggacggagagactttgtccagcagctgcagtaaccagtattccgtccccaccgctgacgtggtgtatgacacacctgttgtgattttttccatctgatgtatgtctccgtcaccgccgacagaaaatgaaagtaaagaaaaacaaaaagccgccagtgtcacccactgacggccaacgccgggagccgtgattatggcattcaggctctgctaaaaatgccagataacattccggccaccccctgattcaggttataaatgacacaatatcttgacaacacccgtcactgtctgtcanaaaatataccgccaggcataagtatcatgtgaaatccaactatccttctgagccagcacctctccaccgaaagtcagtgctggctgtttttttccttaataaagcatctgtaactgaaacaatccgcatattgataatatattgacaggcatcattgctgtctgtgaaaaataagtctctacaaacatataaggccttttagccagcgtcttctttcaggtcagtcgctggctctttttttattatgctgccggtgcatttatctccagcaccagactttctatctcaacgccatacgctgcattttttgtaacatccgtcagcgtcagcgcattcagtcccagtgtcagactgtcttttataacctggaatgccgggccagccactccattcagtttcggagtaaccgtggcactgccggcggtgaacaccagctccagcgtctgccagtcgttaccgtaatcgccgaactcccccagcttcgtgtttccggctttcctgtgatgcatcagattcactctgccgtcagtggtctgagtgaagtacgacatcaggaacggattaccggtacccgtcatcgccacaccatcaggaacgggagcatccgtatacagataaatccccagcccgaactgattgttggtcagcgcgcctgacaggcggaacttacaggtcagtctgccgccctgtgtcagcagggtaattgcgtcatccaccggatgcgtcagggaccaggttttattgctctgcctggtgatcttaaatacaccatctgacaactgaattccgccatccttaatgctccagccctgcgcagcagcctctccggctgccggcagcagggagattgtgcgaacggacgtatctgcagacggacccgatggcgtgttgccgccgggcgagggtttgatttccggtgccttaccactgatgaaggctgaggtgcgcccggctgcgttcagaatagcggttgccagacgatccggaataatgctcctgcgcgcccatgaactgaaatgtgtcgggcggtttgatgatacctggtttccattcgttctcgatgccgcaccgtaatatcctgatgccggaatatccggatcttctgccggcgcgttagtggcggtattgacgccgttaccgtctgtcatgaagggcacaaaataaacgccctcactctccctgtttttatacccgccgtacacggtgtcgtactgggtagcgtatgtatttttccagtaatacgtcgtgtcaccacaaatccacggcacatctgcagcactgccaccatggcactgcgcgttaaacacggagaggtcagcacgaaactgtgccagcatggctgtaaacagcgcaggttgctgtgcgtgggtggcggcgctcatgtcaaactctccctgcatccagcagacggccagcagaacgtttttgggatttttctgcaatgccgcttttgtgcgggaaatcagatcctgatataacggcttgcccaccccccagcgtgccgaatcctggctggcccccgtggactcgctgaatgtcccctccgcgccctgggtaaatgccgaaccaccacgacagcatggtaccagcaggatccccgcgttattcgggatatacgggagcagttttttggcaatatgtaacccctggccgacacagccgtactgccctttgctcaggtctgccttcggatgattcagcgtactcatatcctgcacatcatgcaggcagtggtcggccggaataatatcgttatatctgcaggcagccccacccggcgtcactgtactgcggcgcgccagctgtttaatgcgcggatccggagcatcgtatgaatccggcagcggaagcccttcaccgtaagccatggcattggactgcccggccagtacgatgacgtagtaccaatccggctcagttgcaccactgaccaccacatcacgttctgctgtaatcgcctgcatcagggtataaggggttatggccaccggactaccaaacggctgccagccctctttcagtttgtgtgtcagcttttccgcaaggtctgacggcgacgccgccctgacaacatcataatgtttaatcgacatcgaatttctcccgtgtacaggaacagagttaaaaagccggaaccggaatcaaatcacaggatgaccatctgccagtggctggtcgtaaaaaaaaggccgcgccatgcgcagccggaaataaagggataacgatgatagtttgagaaaaacagaaataacacttttgtggcaaagcatggtgccgggtgcctcccggtgaattcagtaccagcacctgaatccgcgattatcccatataccttcttgctgatcgcccctccgcacagggggattcaccatgcagaagtgtttttaataaacagcaaacaaaaaaatcaagcattatgcaggctgtttctttttatcaccggccacagcaataccacaatgccgcagaccagcaccccatccgccagcaccgacatgattctgctggtgaaatccaccatcaccaccagaaacagcaggagtgcagccacagtcaggcgcagttttaccgtcacaggtgattctccagacgaagacccagaacaccggcaatctcttccagcaccttgcgctcttccggctcaatttcgccgtctgcctccgcaatggccaccgccacatccagcacatcttccgcttcacgcgtatcgtgtttcacatcctcgatctcacgtaacgccgcacgacgaccagttttaaagttcgtatccagctgaccgatnatggttgcgctaatcgcattaatttctgacgtaacgcggacagcgcaggctgattacgcagtacctgttcgatcttcgctttctcggatgcctcacattcaccatctgcacaggccaccaggtatgcggcgttaatcaccacctgtgccagatcgcgtttttcaaactttttaatttccgttgccgctctgcgggctttttttaccaaaaataccaaacatcgtgacgttcctttgggtgggtgagccaacgcccgggagcgatctgcccacagagaaagtcacactgaccactccgtaagctccccccccccccccaaaaggctctgtggttggtatgtgccgggcgtggcgcaaatacaaaaaaggcccgcaaaaccgagccgggaaaataagtgtggcgcgttgtactggaatccaaccagtgaccgattgcttagaaggcaattgctctgtcctgctgagcnaaaaacgcagaataccgataatggaccgccatcggagactcgaaccccgcgaaaccagcttcgaaggctggcgttctatcccgatgagctaatggcggtatgtgatggtggcccttgctggatttgaaccagcggcctggcgattatgagtcgctcgctctcaccactgagctaaagggccgggcgcaggataataacgttacgaaatcaatgttgcaagcattcaagaatcacctggttaaaaattacccttacttcctccaccagcgcattcaccatgtctatccgagataagtggcacaaaaaaacccgcttgtgggcgggttttgtttgcttttgccatcacgtacaaaatcggcaaaatatcagatttgcatgaaatatatgcctttcaatctacttttgcaacactttgctttgaaaatgccgccttttgttttgaacgcgttctcattacaaacaataaagcctcactatccagtcggtgaaaaatgtgtttcattgcaacccagtgacgagtaaatgttttggaccagtttttagttgtcactcccaccagtaatgccagctccttgtattcataaccttccccaccaaaaagttctgcttttactgcctgcgccgccagccagattaattttttcaggcgttcctgcgttttccctgcaaattttctggtaccggatggagtattaaattcattcaaggccactgtgttatcgcgatctgatattcccaacaaatactcccgctgtaacaccacaacaaccaggctttatgatgttcttcaagagacagaacagcccgccgccacgatgatgtcgaaaactcaaccggactgaccagaggaattgacgtcaccttcgccagcgattgctttcccgggattggtggattatcccgcgttatcatttttccagtcacttcatcgcggtaccggattttttttcgcctgtaacgccctgtatcgaacatggcattctcctgccaggcttcaagctgaccttttgttgccccactcaaatcagcggtggcgataatgagctgctcacgcacaaactgtaaatagtggttattcatgcgcactccagttctgtgatttttatccccagccgctcaccaggaacgagctgaccgcgcacaatattgatttcatcaaactgctcgtcgtctatgagaagtccggcatgcgtcagcacatccagtggtgctttcaggatattgtccaggtcacgacggcgcttatccggtggctctgcaataatctttatcaccagccttccggacaggtttaatttcagccgctgctggcgaacaataagtgccacatcccggcgataacgctcaccggcttttgatacaaaatatgtgctgccacgacgtcgccagtaggtgttcaccgtcggcgggtaaggcaaaacaaactctatacgcatcagtaacctcttttacccgagcacgccggttgcaaaggcgtgatcaagaaaacgaaaaattaaatcaacctgggaaccatgcttttcttcgaacgccagcggatccgcatgaagctcgttgtgatgctcccgacacagcggtagcgtgaaaatatcgtgggattttgttcccattccgccctgaccatgaccaatcagatgatgaggatcgtccgctggcttaccacaacacgcacacggctgtgtctttacccagcgtgtgtatttctcatttacccagcggcgacgtttaggtcgtttcatgaaggattccggagactccggatcaacggcaatgctgaccaccgtcttttcctgtggtgggttctgttgctggtgggtgtgaggcggtagcgcaatattttttgtgcgctgcttcagtatgctggtggcggtctgttctcccggtatgatgtcgctttcacggtatacggagcggattttttccgccggtaatcccagagagcgacgcgatactgcctcaggtaatgcgtccaccacctgattgcagactgcccaccaggataattcagccagcgataattcccgctcctgcgtgccattcattacatggcgtatgacgtcaatcatccaggctgtcagattttgttgagtaagttgctcaagtgattcggaggtctggtcgcgcagctggttgtcgcagtgccagcacaacaccattgcgccagcaccgtaactgtgaataacggtttcgctgtgatgataatcgccgtgtggccactggcaggatttcacgtgacgtaataaccagtcagacagtgcaccagcgccgccagctgcacgaatcacccgctcatcgctgaaaaatggcagcagtgatttatcttccgccagcggctggcgaacagcaggaaccgctccagatggcagcgcccgcatgtttttcggttccggctccaccagcaccctgccgcgatgaaaaactggcaatgattcacgaccgggcttaaggaccaccagcccgagttccggaaccagaacaggtcgaagtaatacccgcacattacctccagacgcgctgacggtagcaggcatgtgtccgtggcagatgtgcacgaacaggaagatatacagaaacggtccaggtcagacgatcagcgttcagactccgctccacacggacaccgcgacgcagatacgcctcttgaagcatatctgcctcatcgatcgtacagaacagatagtgaaaccagccatactgaggcgcacgaaaacgcctcccctgcttaatttccgggtcggcttcagaattgtgggattttatgtgttgtgtcatcggattctccggtgacagcaggtgtcagttgttcaggctgactgcgcgaattgtaaggcaatacgccggaatgtacaaacagaaaacccgtcagtaagacgggcttaacaagcaggggcggttactttaataatttcagtgcctttacatcaacttcaacactgctcaggtctttatcaatttcaccctcaattcttactttgtctttcggagaaacattctgcccggcccatacgctgtcatcaatatccgtgacaattgtcccgctattgtcacgaaactcataacgttcatcacccacttttttaacgatgctcccttcaaggataaccatgcatcatccttcagttcttttgcctgcgctactgttgaacgctctgcttctggccctggaaaccaccctgctgtgcaaaagcgccaaaagacacnccggaaataagtgctgcaatcaataccttttcattcatagtcctctttcagagatgaacattcaaacagcattttcagtatggtaaagcgcgggtgcgttgaggatgcctgacacatcaggaggtggcgggagattactcccccgcctggtctcttacttctcanattcgtagtctacgaagacagcgacctccgtctgaccggttcggattcgcacctcgcagaggtctttcctcgttaccagtgccgtcactatgacggttaaacagatgacgatcagggcgattaacatcgccttttgctgcttcatagcctgcttctccttgcctttcggcacgtaagaggctaacctacatgtgttcagcatggattgagcctcagattaatgttaagcgtcttgcaggacgcgtaatgttaactggggcttttctctatctgccgttggtgttcatgcccgaggcagatagcctcaagcacccgcagcaattctacttaactatccttttcccgcaaaccgtttttatccccagcggcaaatcgaatacaccaccagcgccaccgccatcgcaattcctaccgttgtgaatgcttcaggccaggtcattgattcacctcctgcggcggttctggtagcgacatccagtgggttgcttgcctaagatcattacccggactaactgctatacctccgcgccggaacgtgcctccgagatagcgtgcggaatatattaatggcccagcctcgctatcgatattcatcgaaataagcacgttctggctcttttcaggcattcgctcagtacagcttatccagccatccagagttatcggagatctggttgacgtttccgagatttcccgaaaattgttggttgacgaattcttattttcccgaaagtttccggcctgaagcatggcgacgcggcaggcgttccagccatcagcatatgttttagttacaccgtcgagatggcaggtaagcaaatccatttcatcaggcactaccattgctatcggctctgcttccagtgatgccagcgcgatacgaaacacattagccagcaggctgtctgaagacttgttatcgtgcgccgagtcgctcaggaagcctgtgatgtatgatttaatctccgcgcgttctctggtaatagtgctcatatcagttttccttatacggattaattttattgtgcagtgcgctgaatgattcccatgtcacatcggtatatagctcaataactggttcaaatgtccttccaattatccagaccagtaatagcggggatatcggtatcatcaacactataaacagaatgaaaaacagaaactctgttgttctgctctttcgtgggtaatttttttctaaataatgtttcatttcttaccgccctttcgggcggcctcctgatgttctgagggtgcaggaatccctccggttaaggatttaataaaaatcgtttctgatttaaatcttcagtatttagttgttagttggtttatcgcctttatgcttcagccttatttcgcaaccagacacaaaccgggccatcttccgtatcatgaatggaaccaataaaccagccatcgccctctggtcgttccggttcccatgcagaaatatcagcatcacacgcatcaaggtcagcacatccttcatctctgaagcagaggacgtattgaagattattttcctccatccaggcgttaaactcttccgttgaaatatattcccgaccatcacagaatttttcatattcaggatgtgtccagtagccatatccgtcacgaactaccggcatttctttaatttcactcactgttaacctcctgcaacgctacacgatacgccttctttatccacgccttactgccatataatttcgtcttcataaataaacacacctgcacgactcgccgatatccccggacaggttaacagcacagcatccaccacacggttatgcttccgaaactccattacagtactgctgataaccacctgccccaccgggccgtaatcctgatacaggattttcacgcagacaccctcctgtcgaaataaacgtagttattcactatgcgcagcggcatgcctaattttctggcaatttcccttctttgcatgcctctctgatgcagttgccgcgccagctcaatatcacgctgagaatattttgccgacgggtgaaaatcaccacgtaacatcatgctgatgcccagctcccgtgccttcgttctcactgccgcttcagttcgtccgataagtgcgccaacgctttttaccttcatcgttcccgcacactgccggagtatcatgatttccgcccggcaccacgtcttccacccactcaccgctgctgttctctggtggcggtaatatcccggagaatatcccggcacttgttcagctcccgcagcgcggcgcagactcgctcccacttctgaacctgaccttttgcccggcgcagctcgcggttagccacatgcagcgatggtaaaatcagaccatccggatgctttctggtgaacgacggctgtgactgcactgtgaccgccacactttccgtttttatttcttcctgtgtttccgcttccccgactggtaacgcaacacctgctggctgaggaaaggctttaccatccgtttccgttatggatgcggctttcggctctgccggtaaatcagcgcccggtatgcagtaccgaaatttaccgccctgattcacgcgaatcagacgccctttgctgattgccatggccagtgatgaattcgcccggcgggaggtaatcccgaacatcagtgccagctcatccgccgtttgtgggccatgatgttcaatcgcctcagtcagcatttgcgctgtcactttcggtaccggtgacactggttcactttcaccagtctgagtcagccaccacatcgaccccttgttatccgcttcaccacggcgcttcagtttccacagttcgttgacagcatcttcgcggctgattccaaggcgcgatgccactacctgtgaagaggcttttttcagtgctttcagtgcgtcaaatacggtttccattaatatttcctccgacaaaatcgtttctcagattcaaataaaaccagctgccttccggcgttcgtattcctgtttcagccgttcaattggcgttggcccttgcgggtgtttcgccccttccagttgtcgtcgcactggcggaacactcatcccgttaccaacatgctttgcccatttcgtcagttgccgttccgcaagtcgttttaactcaccttgcgtcatctggcgctcaatccctctggtacgcatttcgaggcagatgtggtacagcacaggctgtggccacgggtatttatcactcccgtcgtatcgccaggattcattgcgccagcgccggtactcttccatcacggcatccaccgtaagaccaaatggatttgccccactctccgaaatcagcgcaacaaactcagccaggtccgggggccacgtttcacccgcccggcagcggtccatgcactgacggcacaccagacggatttgctgttcagtcatcgcaccaatctgggcaatccagagcttcgaaggtgcggccccgttcttctgagtccagcggttcgaatacacctcccccatgagctcccacagcttccaggccgtttccgttgctgataaatccgttgtcacgttcccactgttcgcgtgcagcccggatttcctgaactgcccgtgatgccgtgccacctgatgctgcatggcttccccccttgctgactggttttacctgtgccctgacgtgctgcacgtggcgggcaaatttctgctcccactgaacctgcgtgaaaaccttcccctccgccatccagtaatcccggaatgcggcaagctcagcaggtgtaaattccggctcaggcagagccataccccacactgctgcccgttgtcgaaaatccggcgacggctgccagacagtagtcatcgaaaatttcccgatcggttcgctcaggccgtccaggtattcaggttcggctgtctgcaacggcgcaccattcgactcactggtcggaatactctcgcgcgcgttatgtgtggggtttaattctgtatctgtatctttatctgtatctttatctgtcgtgacttgtcgtgacagatgcgtgacacgtcgtgactcatcgtgacaatcagcattatgtttccgcagcttttcccgctcccgctgcgctctcttgcgctctgccggggattttgccgtttgcgaaacgttaccattgtcctctttcagcacctgacgtttttcccatccggaaataaggtcaccatccagaacccgcccctgcattgcatgcaaaattgaatcaattacgtcttccgtcacatcaagcgcacttgctaaatcttccgtcgtgaaatcaatgtgaccacgtagtgacacgccgtgacatgtcgtgacatttcgtgacgcgctcaccagaagatggatatacactgccatcactgttgcgattggctgtcctgataccctggcaatcgttcgccacttggggtcatttggcatgtcatgccacaatctgagccaggcattagccatactcacctcttctgataccgaactttaccctcgaacatccggaagaaatccggcatgaatattgttggtcaatgcacgacaacagcattaccaggctgacccccactgttagtcagggtgccccaggcgatcgccgctgcgacaaaatcatccacatctttcaccagccgatccctccgttcgacgatctcacggtaatattcagagctgtgactgcgcatacgggccaccagcagaagcggcattgccttttcgatcgccggtaacagagcctgcattttttcaactgcatcaggggtgtctttctctatccagcggaaaattttctgggtattgcgagccagggcttccggatggctgtcgtcgtacagttcaggaaacgtcatacccaactcaaaataagcctgggttattccagctgccggaactttttcgccatcaggacgcgcccaggcattcatcgccatgcggatgtgttcatgcttgattttcatgaatccccccttggttagaaggcggattatgatcagaatcgggaatgacaaccgtcggtatgtgtaactcatatttgagcgccccggcagtgactgcctgaattagcaacgcccatttccacggaacgtcttccccccacatgctgactgtggtttttgacgttcctagagcggcggctgttttaacaactccgccaaaatagcctaatacttctgattttttcatgagtcgctccataaaactgaacgccaaaagtttaataatcaaaaccaaagaaagtcaagaaacaaaaccatctgtgttttaaaatcaaaacatgaacaagcaaacaatatctgaacgcataacccaacgtatgcatgcgctaaacttgaaaggcaaagaccttgtcaatgccactggcgcatcaaaaggctccgtaagtcaatggatgaacggtggaggagcgccgtcctcgcgttacataagttcactggcaaagatattgaaagtaaacgaaaattggcttcttaatggaggagagttaaatacaggtgattcgcttgatctatctttaccgccgataaaaacggttccgctactatcacttcagcaggcagcaagctggagtgattatatgaaaaattcctcaataacctcttgtgtgcagcttgtcggagaaatcccggccaatacctttgctgttgttctagagagtgacagtatgtcgacatctggtggtggagtttccatcccaaatggttcaacagtttttgttgatcccgatcgaatcgtacaaccaggaaatattgtccttgccttacccaaagggaccacaacgcctgtcattcgcaaactggagatagaagggccggatattcttttagtccccacgaatcctcgctacccttcaattatgctggatgatctatcttgcatattgggagtatgctttaaaattcaacaagatatttaaccaacctcatctatttgattaactgtatgccatcgtagtgatggcgtaacagctgcctgcttaaaatgttttgataaaaaaacattgaccttaaatgttcgtttttctaaacttcattcattccctcaccccgccccacagaatgcagggcaatacttcgagttaccaggcagtggtcaggggttaagtagccagcccgaggcgtaagaacatgacggcagggttcaactttaataactatgcagcaggtttttgttccgctaccccggcgttaaggggaaatgaggtcaacatggatacgctcaatcttggcaacaacgaatctctggtatgtggcgtgttccccaaccaggacggtacgttcaccgcgatgacgtataccaaaagcaaaacgtttaaaactgaagctggcgcgcgtcgctggttagccagaaacactgactgatgaggttgacgatggaatttaaagatttacctccttcaatccaggagattgcagcacacacacttcgtcatcgtctgaacgaacttgaattggaatcggtaacgaaaaaagacactgataatatggctcgtaatgtgcgcgatgcgtttaccggattgtatttctgtgcgtctataaataaacacgactcagagagtgtggcaaataaaattgcagaaacgacagcgcaaaacatcaatacgaaaccaacggaagaagaaattgatcagtttgctcatgatgctggtttaaaaaacaagaaagaaaaatcgccatatgcggggaacatgtttgtttatgacaatctcatcagaattcgtggcgaaattccggcggaatacctggcaagagtccatcaggcattgcttaaaaatttggaaacagaattatttgatggcaacactaacggtttcttcatggtatcaggccttgagaaagactgggatgcagaaaaacgctggaatgttgctacatggttattcagtaacagagccgctgcactggaagcttcggcatgtatttgcggcctgttcttaacagaccacaaatataatctggatgtgtacagttatatttacgctgaacacggtccactctggattgactggtaattataaggaaacaccagcagggccgcggcgaccaacagaacgattaaaatcaataatgccattataaaggacattatttaatttatcgtcgaatgctgattctgtgagcctcaactctgaatgagtttttaataaccctgattgcctgagttgatttaccaggcattcaatctgtttttcaataagcggatttctttttttgtttggcattttatcctccattgaggttctgggttaaaaatggagaccaacacgctgtcacgtgtggtcgtgcgccggacacggataagaatccggtactgacagtttactgaaaggatatttccctgaaaagtcagtgcataacgcgaaagcgtacggcgaagctctttccccttagaaggcttgtcgtttagatttcttcgaacgtgcgcttccggttgtggcacttccgcgaaatggcgcggcggtaagtatggcggggttattccttccccattgaggacaccgggttgtcaggttgaccatacgcttaagtgacaaccccgctgcaacgccctctgttatcaattttctggtgacgtttggcggtatcagttttactccgtggctgctctgccgccctttttaaagtgaattttgtgatgcggtgaatgcggctaagcgcacgcggaacagttaaaaccaaaaacagtgttatgggtggattctctgtatccggcgttaattgttaactggttaacgtcacctggaggcaccaggcactgcatcacaaaattcattgttgaggacgcgataatggaaacgttattaccaaacgttaatacgtctgaaggttgttttgatattggtgttctgctcagtaaccgggagtttactgaagatgccattaacatgaggaaatatgagccttatctgctcaatgataattccatactttcccgaattgctcttcttgaacttggtattttcggagaacgtcaatgacttcagcatttgcactgatgatgacggtttttcttataacgggtgaatcacagaatgtgattaccggaatttatgccagtaaagaatcctgcctccaggcaagagacgagcaaaaaatttctggtgaatgcctcccggtaaaaaaagtatcgctgtacctgaataacgaaacaccggctggataaccctccagccatattaacaccataccaacggattaaaaatgccagcaatggcagggatttgttcacccttaaatctgtaatgaggtttatcaatgagcactgataaagaagaatttgcgctatattgcgaagcaaaaaatgacaaagtcagaaaacgtctgggaattaaaggtggtttttactggactacagcaaaaaaattatctgttgccatctcccgctgcattaccgcaatggatgacaacgattatgatgaagacgactttaaaaaacccgttcgcgtccatttacccgttgtgaatgaccttccacctgaaggcgtgtttgataccgaattctgcaaccgatacgaaaaaggcggggaagatggcattacaatggtatttatcgcgccctctccctccgtgcaggagaaaccagccagtactgacaataccaacgtcaacggcgaagacatgacggagattgaggagaatatgctcctgccggtttctggtcaggagctgcccattcgctggcttgcgcaacacggcagcgaaaaaccagtaacgcacgttgcacgggaagaacttcaggcattacatatagcacgggcggaagaactgccggctgttactgccttggccatttctcacaaaacaaagctgctcgacccgctggagattcgcgaccttcacaaactggtacgcgacactgacaaagttttccctaatcccggtaattcagacctgggactgataactgcttttttcgaggcatacctggacgctgactacactgatcggggtctgctgacaaaagagtggatgaaaggaaatcgtgtttcgcgtatcacccgtacggcttccggtgcaaatgccggtggcgggaacaaaaccgatcgcaatccgaatttagtacacaccttcgatacgctggatgtggagattgcagcagccacacttccgatggattttaatatttatgaaattccgggcagcgtttatcgtcgcgcaaaagaaatcgtcctgaaaagagaaagtccgttcaaagaatggtccgcagcacttcgcgcaaccccgggtattctggactattcccgcgccgctatttttgcacttatccggagcgctcaccctgagttttatcactacccgggacgccttcaggggtatatcaacgcctacttaacggagactgatcacgagaaccccagcaaggaaactctcactgctgcacgacatacaccggaaaaagatatcctggaagaagttaaccgcgaactgtctgctaagcaggaaacagaagaagaaaatgatgaagaaaaaccgcaaccatcttgcgcaatggcagaatgataatcagaagaaatctggcaaaagaccgttttacagtaccaaaaacacaggcgggaaccaatcgtgtgattcaccttattaagcccgcaatcgacgctctccggagtcagatggcactaacgagactgagcaaagagcatatcatcgatgttcacctcagagaattcggcagaacagagaaacaaaaatgtacctttgtttttcaacctgaagtgtcagcgaaagtaaaaaattatggcgaccattttaccgttgactcaataaggcagatgtgggacgcagcggtaaagcgtgccggaatccgccatcgcaaatcgtatcagtcgagacacacttatgcctgctggtcgttaacagcaggagctaacccggcattcattgcaaaccagatgggccatgcagatgcgcaaatggtgtttcaggtgtacgggaaatggatgtcagaaaataataatgcgcaggtaacgctgttaaatacacagttaagcgagtttgccccaaccatgccccataacgaagcgatgaaaagttaattttttatttatcaattagttagattgaatgactcttgaaatccataattcatagatgttttttactattctgtgggtttttgggtgttttctaagttttttcagatggttgtattttttctaaaaatccctaatctcgattttgctgtttatttgaggcctttttatgtcccatatatgccccacagataccccgcagccaaaatcaacaaaatgccaaaaggttctgttcctgccctgcaacaagaaatgctgcgacgtgtcagtaaacgttatgacgatgtagaagtgatcatcaaatccaccagcaacgatggcctttcagttactcgcaccgccgataaagattctgcaaaaacttttgttcaggagacgctgaaagatacctgggagtctgctgacgagtggtttgttcgctaattaacgagtaaaatcgaccctgtacacgattctgtgtaaatgccttttctcagaagtgaccgtccaggcggtcaccgaactcgataataaagcggctcattgccatacgccagtcccgcagtggcatcgtccatttctgtgaagccgcctggattgccagccacacgacctttttcactgagtcatccgtcgggaacaccttgcgttttttgatggcatgccggattacgctgttcagcgactcgatggcgttggttgtgtagatgactttgcggatatctgccgggtaagcgaagaacatcgccaggttggtccagtttgcctgccagctccggcttatctgcgggtagcgactgtcccaggcgctggcgaacgcttccagcgcctgctggcctgcttcttctgtgggggcctggtagatggctttcaggtcgcgggtgacggctttgtagtccttccaggaaacgaaccgcaggctgttgcgcaccatatgcacgatgcacagctggatgcgggcttccggatacaccgtgttgatagcgtccgggaagcctttcagcccgtcgacacaggctatgagaatatcgttcaggccgcggttttttagttcagtcagcacattgagccagaacttcgctccctcgttttcggccagccacatacccagtaactctttctggccttcgatattgatacccagtgcgaggaatacggatttattgattacgcgactgtcctgccgaaccttcaggacaatacagtcaagataaacaatgggatagaccgcatccagtggccggttttgccattcgactacctgctccataacggcatcggtgaccttcgataccagcgccggtgagacatcaggtaagcgtacagcctgaaccgtctggtcagaatctgacgaattagacaaagtggtgtccaccaaataagtagtgggaaccaaagtatcagatatgcagaaaaatgtgactcccggcaggcgaaaaggctgccctaattatcctcccgaatttaaacagcagctcgttgctgcctcctgtgaacccgggatatccatctcaaaacttgctcttgaaaatggcattaacgccaatctgttgttcaaatggcgacaacaatggcgcgagggaaagctgctattaccttcttcagagagcccccagctacttcctgtgactctcgatgcagctgccgaacagccagaatcgctcgcagaggacccggaaaccctcagtatcagctgtgaggtaacgttccggcacgggacgctccgcttcaatggcaatgtcagcgaaaagctcctgactctgctgatacaggaactgaagcgatgatcccgttaccttccgggaccaaaatttggctggttgccggtatcaccgatatgagaaatggcttcaacggcctggctgcgaaagtacaaacggcgctgaaagacgatcccatgtccggccatgttttcattttccggggccgcagcggcagtcaggttaaactgctgtggtccaccggtgacggactgtgcctcctgaccaaacggctggagcgtgggcgcttcgcctggccgtcagcccgtgatggcaaagtgttccttacgcaggcgcagctggcgatgctgctggaaggtatcgactggcgacagcctaagcggctgctgacctccctgaccatgctgtaaatctctttatcctggttgtcacagaataagcccggtaaaatacgagcttatgaacgacatctcttctgacgacatcttcctgctgaaacagcgcctggccgaacaggaagcgctgatccacgccctgcaggaaaagctgagcaaccgggagcgcgaaatagaccatctgcaggcgcagctggataaactccgccggatgaacttcggcagtcgttccgaaaaagtctcccgccgtatcgcacaaatggaagccgatctgaaccggcttcagaaagagagcgatacgctgactggtagggtgtatgacccggcagtacagcgtccgttgcgtcagacccgcacccgtaagccgttccctgaatcactaccccgtgacgaaaagcgactgttgcctgcggcgccgtgctgcccgaactgcggcggttcactgagctatctgggcgaggataccgccgaacagctggagttgatgcgtagcgccttccgggttatccggacggtacgggaaaaacatgcctgtactcagtgcgatgccatcgtgcaggcacctgcaccttcgcggcccatcgagcggggtatcgccggaccggggctgctggcccgcgtgctgacctcgaagtatgcagagcacaccccgctgtatcgccagtcagaaatatacggccggcaaggtgtggagctgaggcgttcactgctgtcgggctgggtggatgcatgctgccggctgctgtctccgctggaagaggcgcttcatggctatgtcatgactgacggcaaactccatgccgatgataccccggtccaggtactgctgccgggtaataagaagacgaagaccgggcggttgtgggcgtatgttcgtgatgaccgcaatgcagggtcagcgttggcacctgcagtgtggttcgcttacagcccggacagaaaaggcatccatccgcagactcatcttgcctgcttcagcggtgtgctgcaagcggatgcgtacgccgggttcaacgagctgtatcgcaatggtgggataacggaagctgcctgctgggctcatgcccgccgaaagatccacgatgtgcacgtccgcatcccgtcagcactgacggaagaagccctggagcagatcggtcagttgtacgccatagaggcggatataaggggaatgccggcagagcagcggcttgctgaacgtcagcgaaaaacgaaaccgttgttgaaatccctggaaagctggttgcgtgaaaagatgaagaccctgtcgcgacactcagagttggcgaaggcgttcgcgtacgcacttaaccagtggccggcactgacgtactatgcgnacgnntggctgggtggaaatcgacaacaacatcgctgaaaatgccctgcgggcggtcagtctgggtcgtaaaaacttcctgttcttcggctctgatcatggtggtgagcggggagcgctactgtacagcctgatcgggacgtgcaaactgaatgacgtggatccagaaagctaccttcgccatgtgcttggcgtcatagcagactggccggtcaaccgggtcagcgaactgcttccgtggcgcatagcactgccagctgaataacacatccccgtcaatacggccctcgctgtacgcttacgacatcagcgtcatacagctctttaaacgcagccgctatttcgcgggttgtcaggcctttggcgtacaacgacaggatctggttatccatcccggtgatccgggtctggtttttcttcacaagttgcggttcaaaagagccatcacgatcgcgcggagtgcgtagttccaggtggccatcaccggtgataacggtctttgtggaatagccattgcgggagttggcacccggtttaggctggtttttatcgtagcccagatggtgggacatttcagcgttgagagctgcctcaacgctgattttcttcagcaggcgatcgaactggctgagatcttcaggggttttgagatttttggccagttcgttagccagagcctgcaactgtttttcgtccataaattaacctgcttttgatgttggattgaacatatcaaaatcaggcaattacacaaatctatgtacaggctcctcagtaaatatcaatacggttctggcgagccgcttacgatgcatgagaatcactaatagtatgtaattattacattttatttacaatgctgtttctgttggtctgcatccataattatgaaatgctgacttatggtgtcaaaataacacatattcctttcaataatcatttcttttactatcttttccctgctgagagggtggggtagatgttctcttgtgagattcatgaacgcagacttatcataaagagtgcatatgttggagttcagtgcattcttgacaaaaacccctttttctggaacgcataatgttattgggcacttaagaaattgtgtgtcgcaagagaattcatcaggatttacaacaaatgaatgagaatggattttatttttaagggcgttttcggccccttttttccatcctatatttgaagataattgaagcataaaatcctgagatatttgtgcaaaacttcgtccgttgttgatctgctgttccaggttgcgagcaatagtgttttgtctcgccataaatatggagaaatgattactgcatacaggatttactgtaaaaccattgactgattcgatataacggatatccattttataacgttcttttatgattacagtatcattttgattttgctgcacaatataacgtaaagatgctagctcattctcaggtaagatacttcctgctgtgaagtttaaaaatataggcatgttttttctgtaatacaagtcgattgtttgtgatttcgcgctgtaggtatattatcattcatatttaacttcctaaagtatgacctcgtagggagataaatgcaatacttaaaggtagattgaaatgataaattagcgcttggtaaatccagaatttcataaagagagaggtggtgttttttcatagcgctgagatgtaagttgcaacatgtattatatgcaagagaatagggagtactggatacattaactctatgtaatccattcaagatattaatgcaattgaaataaataagaaactctaactctctcccctcccaggagaaatccaccaatctgcccttccattacctgctgacgcatctccgccatctcattcgcgaatgaagtcgatgatatatatgatactaatccaggcattaccatattccttcatacagataaatatttcctctgggcttcataacaaacatctccctgacatgacaacaaaaaccggagccggactccggtttttgtgaatccgtcggctatttcatcccgccaatatttccccgtcagcacgccagatttgcagcggcctcaccactcactgtatatgctttttagctgcatccagtacaccaattaccacatccttataccctgaacatctgtagcatttcatataagcaactggcagttaacatatagcttgggtaatatttatttcacttatcctttatgacaaagtttcctttggtttggtcataaatacattgttcttgacttacaatcattgatgacgttattggttctcgtgttagcgggtgcttcccaccgtcgcgaaccaaatgagaaaaagaaaccgaatcaaataaggtacaaaccaaagaaccttctgaatttttaacaaacacaccttcttctggtttatccagtataattgggcatcgaaccgcctcggatggacactgaaggctctccgtattaacagaaaacttacattgtgatattttcccctcaatatcaccatgtgattgtgtgttacctgaacctgaaaccattcttaacattatatccctgagcgcttcaggaccaccattaagccctgtaagtaataatccagaaagcaaactgttattgcccccactcgccagaaagcgaccatccgtttcactatatgtgatacggaccgtctgcccgcctactgtaatttctccaccgccactggcggccatttgagcacgaagaacctgcattcaggtggaaaatgaattggatgcaatagctgatgttaacggcatgacaaaactccctatttaaatattcattccaaacacagggagtcataacaaacagcccccatacatgacaacaaaaaccggagccggactccggtttttgtgaagctgtcgggctatttcatcccgccaatattttcccacgtcccgtcagcacgcaggatttgcagcggtcttaccacgcactgtatctgctttttatccgcatccagtatcaccacctgcgtgattaccctgtgaaccgccccggaaatcctggagactaaactccctgagaaagaggtaaacaggatgactaaaaatactcgtttttcccccgaagtccgtcagcgggcgattcgtatggttctggaaagtcaggatgaatatgactcacagtgggcggcaatttgttccattgccccaaagattggctgtacgccggagactctgcgtgtctgggttcgccagcatgagcgggataccgggggcggtgatggtgggctcaccagcgctgaacgtcagcgtctgaaagagctggaacgtgaaaatcgtgaactgcgccgcagtaacgatatccttcgccaggcttccgcttattttgcgaaggcggagttcgaccgcctctggaaaaaatgatgccactgctggataagctgcgtgagcagtacggggtcggaccggtatgcagcgaactgcatattgccccgtcaacgtattaccattgtcagcaacagcgacatcatccggataaacgcagtgcccgtgcgcagcacgacgactggctgaagagagagatacagcgcgtatacgatgaaaatcatcaggtgtacggtgtgcgtaaagtctggcgtcagttgttacgggaaggaatcagggtggccagatgtacagtggcacgtctcatggcggttatgggacttgccggtgttctccggggtaaaaaggtccgtacgaccatcaaccggaaagccgttgccgcaggcgaccgcgtaaaccgtcagttcgtggcagaacgacctgaccagctgtgggtggctgattttacttacgtcagcacatggcagggcttcgtctatgtggcgtttatcattgatgtgtttgccggatacatcgtggggtggcgggtctcatcgtctatggaaaccacattcgtgctggatgcgctggagcaggcgttgtgggcccgtcgtccgtccggcacggtccatcacagtgataaaggttctcagtatgtatcgctggcctacacacagcggcttaaggaagccggattactggcatcaacaggaagtacaggcgactcgtatgacaacgcgatggcggagagcatcaatggtctttacaaagcgaaggtaatacaccgtaagagctggaaaaaccgtgcagaagtggaactggccacactcacgtgggtggactggtataacaatcgacgattgctggaaaggctgggccatactcctccggcagaagcagaaaaagcttattatgcttccatcggaaacgatgatctggcagcctgagttcacagataaaacactctccaggaaacccggggcggttca

SEQ ID NO: 61 - DNA  (genomic), 2512 bp; double-stranded, linear
accggggcagcaggcccggcaggcccacagggaccgaaaggagaaacaggtgcggctggcccggtgggggcaaccggacctcagggaccgaagggcgacccgggggagacacaaatccgttttcgtctggggccggcgagcattattgagacaaacagccatggctggttcccgggtacagatggtgcgctcatcaccggactgacctttcttgcccccaaagatgccacacgggttcaggttttttttcaccatttgcaggtcaggtttggtgacgggccgtggcaggatgttaaggggctggatgaagtgggcagtgatacaggcagaacaggagaatgacatgaacatattaaaaaaaattatgcagcgtctgtgcggttgcggaaagcatgatgactgtgaacacgggcagtcgcttacagtacaactgcgactggggccggcagacatcctggagtcagatgagaatggcattattccggagcaggacggggtaatcacgcaggtggtgatactggatgcagataaaaagcagatacagtgtgtggtaagaccgctgcaaattctgcgtgctgacgggacgtgggaaaatattggcgggatgaagtaacccgacagcttcacaaaaccggagtccggctccggttttttgttggttagatgtaatctgacagatacctgtataaataaccggtaactgtcaggtcagagctaatataggtaattatattataatcacgagcgcttagatgtattaatgccatgctctgcaagatgctgcatcagacgctgagccacatcaggcaaaggtcttgattgttcattttgtactggcggcgttggcgcaggccagttaggtgccggaggaatatgttcagccatattccgggctggttgaatgccatgctctgcaagatgctgcatcagacgctgagccacatcaggcaaaggtcttgattgttcattttgtactggcggcgttggcgcaggccagttaggtgccggaggaatatgttcagccatattccgggctggttgaatgccatgctctgcaagatgctgcatcagacgctgagccacatcaggcaaaggtcttgattgttcattttgtactggcggcgttggcgcaggccagttaggtgccggaggaatatgttcagccatattccgggctggttgaatgccatgctctgcaagatgctgcatcagacgctgagccacatcaggcaaaggtcttgattgttcattttgtactggcggcgttggcgcaggccagttaggtgccggaggaatatgttcagccatattccgggctggttgaatgccatgctctgcaagatgctgcatcagacgctgagccacatcaggcagaggtcttgattgttcattttgtactggcggtggtggcgcaggccagttaggtgccggaggaatatgttcagccatactccgggctggttgaatgccatgctctgcaagatgctgcaccagacgctgagctacatcaggtagaggccgatgtaaagcgtttttttctatacttgactgagtataagatgtgggacgttgaagtcctgattctgtataagaattttttaccttaaaaatagttgttgcactggcaggactgttgctgggagaaaaaggtgagctggtttttaccgtgttaggtgtgcttttgtgctgcgagacagtgaaggtactgctgcgtatagcacttgatatactgcgaggaaggccggaaaaaaagaattaatgctatttatcatatagataaccttataagagctttattggatagtcttatttatccgtttacatgaaatctaccttttgtgaaattctcgtcaatattttactcaaaatgatcggctgtaggaataaactatttgatattattacgtttttagagttgttttcaatcagctatagatagggcttggcgccagaatggagaatatttaacgaggaatagaagctttgtatcagacgggcttccctaaatagagaagttaaataatcaggatgatgctaatgaatatcagggacaaggtgagtgtcttcatgttcagtgaaacagggtgtcacaaaaaagattggggagggctagagccttctgcacgaaaatagtgatgcgacagatctgagatggctttgtatccttctgcctggttcaggcctggagcagtccatgttttacaaaaatactcggcagcgtaacgtgttgcaagagcggcatcagacgaggaacctgaggttccgctcatgaccgataatctcatccgaataaaaatataccaattggtataccaagtttataccaagagccaaaaaagcaaaggggctaccatttggtaaccccttgattatttggcggaagcgcagagattcgaactctggaaccctttcgggtcgccggttttcaagaccggtgccttcaaccgctcggccacacttccggaatgacgcgcactataaacatcccgatgcggcgtgtaaacccctaatc

SEQ ID NO: 62 - DNA  (genomic), 61663 bp; double-stranded, linear
gtttcaacatgtctaaggatatggtttatcattttgaaaaatataattttatttcatcctcctggtcactttggggcacgtctggggcacgggcattaaggacattattcaacatggcaacttgagtcacgctgcactcaggcatccatgcaccataaacattgtagaccatgctggcgctggagtgccccatctgtgatgcaataaatgtcgggtttgctccggaagataaagcccagcacgcataggtatggcgtgactgatacgctttacgggatcggatacccgctctttttattgctgaatcccatgtcgctccgatggagcttaccgcgtagttaatacccgccttgtgattcttgcgaacgatttgcggacagaaaacaaaagtgcactcgtgcaaaattgttcttccgtactcgcgtaattgaacagtgatctgatgctgcctgctaagacgagtaagcatcgcctggtttttaagtgcttcaattgctggtgccagaagatgtataacccggttagtgcctgcgtcggtctttggtagcgtaaaatcacctatttttgtaaaatttcgtcgcactgttatcgtgccagctttcaggtcgatatcctcccatgcaagtgcggcaatttcaccgtgtcgcatccctgtaaaaacagccactgtccagaggtttttggtctgttgatgatggcaggcatcaatgagacggctaaactcatctctggtcagtggatccggcactggttttgatttcctcagcggtgttattgaattaaacgggtttttctccagatacccgttttcggcggcaaagctgaacattccggctgttgttgtcatgtaatagttcactgtgggtacggttcttccttttcgggacgtgctggttttcctgcttcccttttccccggtcagtaaatctttcctgataaacagcagatcttcttttgtaatcgatgacgccagcctgccaggaccaagcctcggtagcatatttttcatcactgattgataacgatttaaggcgttactaccgatttccattgctttcagagtaagccatttctgtgccagttcaccgacggtgatatctttttttaccaggccaaatagcttcaggttaggtgagtcagggaatcgatcggcataatcaaacgttcctgttctgattgcaaagcagaccgaagcccttaactcaccagcgatctttctgtttttcggtgtatcgggcacgcgaagattttcgcgcactcgtttacccctgtacttaaacgttattcggagttttcctccgtgattttcaacgccggctggataggctgaattcgccattgttcctcctgcgtccaagagcacgctcaggttatactcttatggacaagaattaaacatcctgagatggtaagggttggtttttgatccaagtgttgatggtaggaagatgatagagacattcgctgtttttctttggcgttccgtcgggggcgatttgtttatattctctgccgttcatccacgcactgtccctggcgcgtaatattgttccttttctcaggcctgttacagccattaaaagctccagtgttacccattcattcgcatttatctgtacaacaggtgtgatgactggctgaatgccatggttatgttggtttactaactcgcgcataagttgcctctgcatgtgtaagaaaaaaccgccatcaggcggcttggtgttctttcagttcttcaattcgaatattggttacgtcttattcgatgcgcactcctggtatttcgccttttgatattgctaagtcataaatttgcgcggcactatacccatctcgcatccatgaatctaaggcgcgaacagcctcgctacgctttttatcttctctctcatttttgatatcaacgaggacatcaacgcaattaaggcaaatgtggattttgtctttacattcgatcatggcggctttgccatgatttccgccacacagtgagcataaatcttcagggtctggctggtatttctgtaacgttagagggttgaatgttgaacaggccataatcatctccataaaacaaaactcgccgtagcgagttcagataaaagaaatccccgcgagtgcgaggattgttattcattgccgatattcacctttatcgcgaacacctttaccggtttatcaccgaagtgcggatgtgtgattgtcttgatttcatatccgtcatacggaacatcaattcttcggctggaatcgtcgcgcttcggatatccctttgtgataatcaggcggtcatactcgcggaacataattcgcttattccagtagtcattaaacaggcgatactcttccgttttctctccgcgaatcatggcatcgaagtattcacctttaacggcaagttgcaggttagccacggttaacctcctgcggcggttctggtagcggcatccagtgagttgcttgctcaataccattacccggcttaatcgttgcatctccgcgccgaaaggtgcttccggtatagcgtgcggagcatattagcggttcaaccagagagctatcgaaattcaccgaaataagcacgttctggcccttttcaggcattcgatcactacagcttatccaactatccggagttaccggagagttaccagcctcataagcggatttcatccagtgcgtaagcgtttcgatgcttacacatccgcaatcaacgtctattttttctttttgttctgacaaccattcctggaatgacagcttggcagtctggcttgctggatcaattcgtggcaggccgatatatagtggtacatttcccggctccatcgaattgtcgggacaaataaacgtgttacaaccatatttaacgagctcaattcccactgtgtcgatagtggcgaatggttcagtggtcaatgcagtcaacgcaatttcataagcacggcgctcaatattatctcgcacgtccaggctgccgattcgctctttgatttctttaatcatttctttgtcggtgaacgttgtcatgtgttagtccttatccacttcaacgccatctttcagcgtgatgccgtgccaatcatcagcccaactggttaacccaggcgcatcaatgctaggcatatagacgcttgcagtgtggtagcccttatcgttatcaatgctggcaacgtgctcgccgttgtatgcgctcagcgtgtctaggacactataaaactttcctccggctgccctgaaatcctttacagccttcacaagacgattccacgctttttcctgttctggcgtcaggtcgattaattcctgcaaagttgccatttcagttttccttatatgggttaattttattgtgcagtgtgttgaacgacgcccataccacgtcgttatacaactcaataactagctcaattattttcccgattgcccagacaaaaattagcggggatatcggtgtcatcaacacgataaacagaatgagaaacaaaaattctgtcgctctactttttcgcggatattcttttctgaataatgtaggcacatcactctcctttgttgctcctcaaaattttatgccctggcgcaaaagcacgcgttttgtctttgcttattcgccagccatccttgcgcgcctcttttgcacagccagcccatgacgtaccgatatactcaccgaagtctggcgacttatatttgccatctgtacactggaggcaatcacaatagagatgcatggtgtaacttgcagcaatagccatatcactctcctttagtgcgcaagtggtttttccagcggttttgctccgcgctgggctttttgcaaaaaccacaatccatcatcccgtaatatttcatcaaccccatccgtcggttgctgagtctcacccactgccagacgccaggagcgtttctacgaactaacagaatctttgctttacggtttttcatcgttttgctctcctgcatctctttgctgctcgtcgtgccgctgcaataccggtatggcggcgctttggtgtcgggatgatgttctttgcaattagcgcagaagcccaaaaacgagtcggatacggtaacaagccgatacatgccacacgcattactcacctcttttgatgcgaatgccagcggcgcgctcggcttcactttgttcccaaaaccacttgtgaagcgccataagcttttcgtcaatcggtgcatatttgcgattaaagtaggcctgagcatctttctcagattcgtccggtaattcgccagggccaaacagtgtgttataaatccatgctagtccgctcttagcgtcgccagttgcctgccattcgataatggcagcctgcatgaccagaatgtttttcccgattaataggtccagttctttgtaccggttgcggatgtatgcattctcgctttgtaattttgcgttgcgcttttctgaggcttcaagtaacgcctgcttatcgcgtagagcttcttccagttcagcaacatggcattcactatcaataaggttgttctctgctgcttcaagctcaacacgcagcttcccaaccgtaagcgcaatctcctcgttctcctggtcgcggcgtttgatgtattgctggtttctttcctgttcatccagcagtgccagcacggtagccgggttagcctctgctatgaattcagcgtttgcataagcctgatcatctgattcaatcaggcagttaacatgacattccgcaatcacgccaccgggttctcctttccatttttggcaaacaaaaactcctgttaaattgccgtgctggttaacagatgtatgccctacgatgtagcttcctttagttgctttctctgccttttcacgcagtgcctgataattaatttcgctcacttcgaacctctctgtttactgataagctccagatcctcctggcaacttgcacaagtccgacaaccctgaacggccaggcgtcttcgctcatctatgggatcgccacactcacaacaatgagtggcagatatagcctggtggttcaggcggcgcatttttattgctgtgttgcgctgtaattcttcaatttctgatgctgaatcaatgaggtctgccatctttcattaatccctgaattgttggttaatacgcttgagggtgaatgcgaataataaaaaaggagcctgtagctccctgatgattttgcttttcatgttcaccgttccttaaagacgccgtttaacatgccgatcgccagacttaaatgagtcggtgtgaatcccattagcgttaccgtttcgcggtgcttcttcagtacgctacggcaaatgtcatcgacgtttttatccggaaactgctgtctggcttttttgatttcagaattagcctgacgggcaatgctgcgaagggcgttttcctgctgaggtgtcattgaacaagtcccatgtcggcaagcataagcacacagaatatgaagcctgctgccagaaaaatgcattctgttgttgtcatgccgggtctctctcgtttgcttctgctttcgccgccatcatttccagcttttgtgaaagggatgtggctaacgtatgaaattcttcgtctgtttctactggtattggcacaaacctgactccaatttgagcgaggctatgtgccatcccgatactcgttcttaattcaacaggagatgctttgtgcatacagcccctcgtttattatttatctcttcagccagccgctgtgctttcagtggatttcggataacagaaaggccgggaaatacccagcctcgctttgtaacggagtagacgaaagtgatcgtgcctacccggatattatcgtgaggatgcttcattaccattgctccccatatacaaaaccaatttcagccagtgcctcgtccattttttcgatgaactccggcaccatctcgtcaaaactcgccatgtacttttcattccgctcaatcacgacataatgcaggccttcacgcttcatgcgcgggtcatagttggcaaagtaccaggcatcttttcgtgtcacccacatgctgtactgcacctgggccatgtaagccgattttatggcctcgaaaccaccgagccggaacttcatgaaatcccgggaggtaaacgggcatttcagctcaaggccgttgccgtcactgcataaaccatcgggagagcaggcggtgcgcatactttcgtcgcgatagatgatcggggattcagtaacattcacgccggaagtgaactcaaagagggttctggcgtcgttctcgtactgttttccccaggccagagccttagcgttaacttccggagccacaccggtgcaaacctcagccagcagggtgtggaagtaggacattttcatgtcaggccacttctttcctgatcggggttttgctattacgttgtgaatttctgaagctgtgatgacgccgagccgtaatttgtgccacgcatcatctccctgttcgacagctctcacgtcgatcccggtacgctgcaggataatgtccggtgtcatgctgccaccttctgttcagtggctttttgtttcaggaatccaagagcttttactgcttcggcctgtgtcagttctgacgatgcacgaatgtcgcggcgaaatatctgggaacagagcggcaataagtcgtcatcccatgttttatccagggcgatcagcagagtgttaatttcctgcatggtttcatcgttaaccggagtgatgtcgcgttccggctgacgttctgcagtgtatgcggtattttcgacaatgcgctcggcttcatccttgtcatagataccagcaaatccgaaggcgagacgggcacactgaatcatggctttatgacgtaacatccgtttgggatgcgactgccacggccccgtgatttctctgccttcgcgggttttgaatggttcgcggcggcattcatccatccactcggtaacgcagatcggatgattacggtccttgcggtaaatccggcatgtgcaggattcattgtcctgctcaaagtccatgccatcaaactgctggttttcgttgatgatgcgggaccagccatcaacgcccaccaccggaacgatgccgttctgcttatcagggaaggcgtaaatttctttcgtccacggattaaggccgtactggttggcgacgatcagcaatgcgatgaactgcgcatcgctggcatcacctttaaatgccgtctggcgaagagtggtgatcagttcctgtgggtcgacagaatccatgccgacacgttcagccagcttcccagccagcgttgcgagtgctgtactcatccgttttatacctctgaatcaatatcaacctggtggtgagcaatggtttcaaccatgtaccggatgtgttctgccatgcgttcctgaaactcaacatcgtcatcaaacgcacgggtaatggcttttttgctggccccgtggcgttgcaaatgatcgatgcatagcgattcaaacaggtgctggggcaggcctttttccatgtcgtctgccagttctgcctctttctcttcacgggcgatctgctggtagtgacgcgcccagctctgagcctcaagacgatcctgaatgtaataagcgttcatggctgaactcctgaaaatggctgtgaaaatatcgcccgcgaaatgccaggctgattaggaaaacaggaaatggggttagtgaatgcttttgcttgatctcagtttcagcattaatatccattttttataagcgtcgacagcttcacgaaacatcttttcatcgccaataaaagtggcgatagtgaatttagtctggatagccataagtgtttgatccattctttgggactcctggctgattaggtatgtcgataaggcgtttccatccgtcacgtaatttacgggtgattcgttcaagtaaagattcggaagggcagccagcaacaggccaccctgcaatggcatattgcatggtgtgctccttatttatacataacgaaaaacgcctcgagtgaagcgttattggtatgcggtaaagccgcactcaggcggccttgatagtcatatcatctgaatcaaatattcctgatgtatcgatatcggtaattcttattccttcgctaccatccattgaaggccatccttcctgaccatttccatcattccagtcgaactcacacacaacaccatatgcatttaagtcgcttgaaattgctataagcagagcatgttgcgccagcatgattaatacagcatttaatacagagccgtgtttattgagtcggtattcagagtctgaccagaaattattaatctggtgaagtttttcctctgtcattacgtcatggtcgatttcaatttctattgatgctttccagtcgtaatcaatgatgtattttttgatgtttgacatctgttcatatcctcacagataaaaaatcgccctcacattggagggcaaagaagatttccaataatcagaacaagtcggctcctgtttagttacgagcgacattgctccgtgtattcactcgttggaatgaatacacagtgcttattcgtactaataaaatacccaattttctgtttcttggttgtgtccaaagttatattcaatatctggtgttgatgtatcaatattcttcataccatcaacaagagttgatacaacagccaaatcttgtttgattctcattaaatggtatttcttccggcgcaataaactttcaatggcaagtttcttcgttgggaatgcaaaagatctttctgcattttttgctactttcttaattgcatatctatttctcctttgtttccattcctgtaaccactgatttggtgctggtttaaaattaacaatccaatgcgcaggaaccaaccatgcataatgctctgtctgatgaaaagctatatattgaagtgcgaatatttttatcccatcttcttcaactgtcgcctggaatctccagaaaacaggcattccatcatgttcagtttctgattcaggaaaaggtacgctccatgattttgtcatatctcacctcaaataagtggtttgctgcctaatttcattttctggcgaccaacacaagtcacctcgccgtcagttgttttgatttccggtagcctgccgcgtaaatggctacgtttggaagacatacaccagtttctggttgcttatgtccaaactcattcgcgtacacaatggccgctcgctccagattgcgtctgtattctttctgttgccagatcacgtcctgtgccatgaacttaattggcttagcgtcttctatgcgctcaggcgtttcgtgagtacctttagcctgaatctgcgctctgcttagagtagggcggtgtaatacttctgaacttattgcttcttcgcgggccagtacgccgttagctaatgcctttgcctttaaacgctcacgacgacgagaacgtgaattgcctttgaactgagttctgcgtgtcatatagacctcctgatgaactttggtggtgtggtaggtgggagacccatttcgacctgtttcggcctacttcaattcggcaatagtcccgcaggcctcgccgctttacgtgcgacatattcccgtccatgaacccttcaccacaccccaaagttcactttggttattgcgctttgtcagcgccgtagattcatattcgaatcgttgtatattcaccgccctggtgagtaatgcgtcctgctgacgacgataataatgaaccaatagttcgacattatcaagaactattggtacgaattttggtgatttattaactctacgaagtatgattctgatatataaggaaatttatttttgaaaatgtggctgatgaaggttatgcggcagggatcataactgcatggtttagcgagttacatcaataaatacaattggttatgttttttaggtgggcgaacgtgaggcaaagaaaacccggcgctgaggccgggctagattttaaagtatttatcttttagagatgtagatgtaaaacttttcgcctttgaaaattttttgtcatcagaagggcttatgaactcatcttttttgtagggaaccgctaatgctgcatcacgtctgcgaggcagcttgcttacttcctcgcgctttttcatgatcagttatcctttaataacctatacagttttgtaggggtacatcctgaggatattgttaagttcgtagcacgccttttccgcccatcatcgtataaacgaaaaccagtagtagacgaattttctgcgtcaaaaactatagacagtatagcgtccccagactttttttgccattcgcatgtgccgttagttggtttcgtcatctgtagacgccagtcaagaacgccatcacttatagctgagagatcgtttagtacatctagtacggattgatatctttcatttggatctacatgaatgcatttgttcactattgttattaattttttatgtatatggggaggatactcttttaatggatagcagccattaattatcgactctctgagttgttcaatcgtgctaaatgcagatctttctctttcaaaattatcatgtccaacacacattctatatatggttaatcctgcctgatatatgtcatatgtgaaattataatcatttgttgataaagaaaaatattccggtggcacatgaaaatgatatccaaactcaggcgcagctctcgattcctcattgactaactgagataatccaaagtcagatagcatggcctcatttctgtttgatatcataatgttattaggttttatatcaaaatgcataagaccttttgagtgtatatgataaagtccacttaaaaattgaatggaataccgtattatctccctgcttgtaagattattttttttcattaattggtttagcgaaccattatgataaaatggcatggctatatagatattgctctcacattgagcagcatactgaacttgcacaatatttggatgtgcatgtttatagagaagccttgcttcattaaagtagtcgtcgtggttagtgttttcttttttttctatttctttaatcaccaagtcatgagctaggtgtctgtcatgagccagatatacttttgaaaaacaaccctgttcttctagatcactaatccattcgaattctacatcagctcttttgtatggagttagcatccccttacctccgcagatagtgcagccaaaacagcttcatttgtttcagttgtaaaaccagaattatcgattccatttatattgcggtgtgacttcaatatttctttatactcgatctctgttaggttcaatgatgatttcatgccagattttctaatagtgtaatattttcttacatcactgcttgaaaatgcttcttgaataacagcttctatataaaggcggtcaatgctaagattatcagagtttgattcagtaacgcgtatggcagctaattcaacattatataaattaagaatgtcgaggatgttatttctcacatactttaatttttctggtgtgtctaaggtcgaaggtattttaataacatcaacacatttgagtgcagactcattagtgcaatatacaacaaaagatgtaactttgggcgccgctctaacacctagtattctcattttttatatcctattttagaatcaggccgcatctctgcgaccatccatcatccaaacgtctcttcactcatccgaagaagcagcaatccgggttagcacgcacaagctcaagcgcatcagtcagcgaaagttcagtactgtactgatgccatttcatatccttccgcatccaatagattttccatctatccagagaacgtatgtacttgattcttgctgatggcaggatgtttgtttcacctggattgccctgccacacggggcgctgttcgccgatatctatcgtttggtcattgatgctataaacaatatccagttcattgcggatatgttcaggcggccttatgctttcaatgaattggtgaacttctttttttactgcttgatattcaaggtcattgaacgccatctatcctccttacccaaacgtctcttcaggccactggttaccagctatgtgacgatgaagtcacgaacttttcagccactcccttgcctcgatgtcatccagatggcgagattgcttcagaataccagctacatactccacctttgctacttgatgataaggcaacgttataggcctgtgatcctggttaatgcttgtaaattggtattctccatctctgtcatagccaagaaccttaatcatgttgtgtccttcaacggttctgacaaacacctcatcacccgggaatactttggtgttaggctcaatgagtacatattctcctgattttattctgggccacatgctgtctcctttcacacgaagaccaaaggcatctggatcatcgctataaattttgagccacccatcgcgctcttcggtcatctcgatggcaccatcaacaccaagaattgcctcaccaaccacgcgcactaaccctttttttaatttgccaacaaatgaaagagtatcttcatcattcgctccatttaacgaagtgccgtgctgaagccaaacaacatcaacgtttagaaatttcgcaagcgcattcattttttcctgacgcggtaaagactcagcattaaaccatttgctaacgcctttggacgaaagagaaagggcacgggctatagccattcccctaccatgttcatcaagaccagcttctttacaggcttgcgctagccgctgggcgaattctttgcgcactttttcattctgaaccatgagtacgatactaaagcacttgcaaaaactttcagttcaaccataatacgtactgaaagtacgaaaaaggatattcctatgcaaaatcttgatgagccgattaaaggtgtcggcatccctgaagttgcgaaggcttgtggagttagcgaaagggctgtctataagtggctcaaaaacggcttcctccctaagactgagttttttgggaaaactaaatacgcatcaaaaatcgaagagatttctggtggcaaatatcaagcaagcgaaatgcttgaaataagcaaaaagaaccttctggctgcataagtaacaccgctattttcacaatggacattcgtcctacgtcgctgacaaagcgagtcccaatatatctgaccaactaaggccatatgcgtttccacgcatacctttcaactagctattcactattggaaatcttaagaaatggaacaaacaagttacagcaaactatcacagcgagaaattgatcgcgctgaaactgatttactcatcaacctgtcaacgcttacccagcgcggtctggcaaagatgattggctgtcatgaatcgaagataagcagaacagactggaggtttatagcttcggtcttgtgtgcttttggcatggcatcagacatcagtccgattagcagagcttttaagtatgcgcttgatgaaatcacaaagaaaaaatccccggtggccgccggggactctaagcaaattgatatgcaattctgagggaattactggatcaatccacaggagtcattatgacaaatacagcaaaaatactcaacttcggcagaggtaactttgccgaacaggagcgtaatgtggcagatctcgatgatggttacgccagactatcaaatatgctgattgaggcttattcaggcgcagatctgaccaagcgacagtttaaagtgctgcttgccattctgcgtaaaacctatgggtggaataaaccaatggacagaatcaccgattctcaacttagcgagattacaaagttacctgtcaaacggtgcaatgaagccaagttagaactcgtcagaatgaatattatcaagcagcaaggcggcatgtttggaccaaataaaaacatctcagaatggtgcatccctcaaaacgagggaggttcccctaaaatgagggacatccctcaaaacgagggaaaatcccctaaaacgagggataaaacatccctcaaattaggggattgctatccctcaaaacagggggacacaaaagacactattacaaaagaaaaaagaaaagattattcgtccgagaattctggcgaatcctctgaccagccagaaaacgatctttctgtggttaaaccggatgctgcaattcagagcggcagcaagtggggaacagcagaagacctgaccgccgcagagtggatgtttgacatggtgaagaccatcgcaccatcagccagaaaaccgaattttgcagggtgggctaacgatatccgcctgatgcgtgaacgtgacggacgtaaccaccgcgacatgtgcgtgctgttccgctgggcatgccaggacaacttctggtccggtaacgtgctaagtccggccaaactccgcgacaagtggacccaactcgaaatcaaccgtaacaagcaacaggctggcgtgacagctggaaaaccaaaactcgacctgacaaacactgactggatttacggggtggatttatgaaaaacatcgccgcacagatggttaactttgaccgtgagcagatgcgtcggatcaccaacaacatgccggaacagtacgacgaaaagccgcaggtacaacaggtagcgcagatcatcaacggtgtgttcagccagttactggcaactttcccggcgagtctggctaaccgggaccagaacgaactgaatgaaatccgccgccagtgggttctggctttccgggaaaacgggatcacctcgatggaacaggttaacgcaggaatgcgcgtagcccgtcggcagaatcgaccatttcttccatcacccgggcagtttgttgcatggtgccgggaagaagcatccgttatcgccggactgccaaacgtcagcgagctggttgatatggtttacgagtattgccggaagcgaggcctgtatccggatgcagagtcttatccgtggaaatcgaacgcgcactactggctggttaccaacctgtaccagaacatgcgggccaatgcgctgactgacgcggaattacgacgcaaggctgccgatgaactgacctgtatgacagcgcgaattaaccgtggtgagacgatacctgaaccagtaaaacaacttcctgtcatgggcggcagacctctaaatcgtgttcaggcgctggcgaagatcgcagaaattaaagctaagttcggactgaaaggagcaagtgtatgacgggcaaagaggcaattattcattacctggggacgcataatagcttctgtgcgccggacgttgccgcgctaacaggcgcaacagtaaccagcataaatcaggccgcagctaaaatggcacgggcaggtcttctggttatcgaaggtaaggtctggcgaacggtgtattaccggtttgctaccagggaagaacgggaaggaaagatgagcacgaacctgatttttaaggagtgtcgccagagtgcagcgatgaaacgggtattggcggtatatggagttaaaagatgaccatctacatcactgagctaataacaggcctgctggtaatcgcaggcctttttatttgggggagagggaagtgaacgatagctaccgacagtttgaaaactggtggtcaaaagacaaaagccagttcacgggagacgatgaattaaaagagtttgcctgggtgatatggcaggcatcgcgctctgctattgaactggatatcgactggcccgaatcgaatgacgacttttggaaagatggtgaagaaggtgcttatgcgatgggttatgaggatgggcgtgacaaaacggtaattgcagtaatgaaagccatcagggccgcaggaatcaaagaaaagaatttcgattaagcaaatatcacttcaataaatcgcttttaaggcatcacaatcgctctgtagtgaggtaaacgcgtgcaaggcatgccaatagcagcgagaatgaaaaatgcgtcagaatgcgtttgaggaggttttaagaaatgagtacgatagctgagcttgtcagggctaattttcgtgaagagttggtgcgttggtatcggtatcgttcatcgtccagtttgccgcttgatgagttgtatgagcattcacctgccgcacgatgctatccgcgtgaccgtgttcttcgacggttgttcaaactcaacaatgagtttcagcgcaacagaattatccggagtctggattttaagtgaaggagtgagcatgagcgacctatcattaacccagccaaagctaaaagaatgtccgttttgcggcggtaatgctcgtctgtgggttgaggccggaataaatattgatgtgtggggctatgcagaatgtgacctctgtgaagccagggggggcatgggcaccatcagttgctgcggcggctgaaaaatggaaccggagagcaggagatgaagcaaacctttctgcttcgcaacgaagcaatcagaaataacgccatagacgccattctctcactacccatcgacgacaagtcaccccacgaagtccacgttaaagaacccaagcgcagcaaagcgcagaatgaccgtatgtggccgatgctgaacgatgtttcgcgtcaggtgctatggcatggtcaacggctggcgccggaagactggaaagacctgttcactgccctgtggcttaagaccaaaaaactggagcaacgaagtgtgcctggtatcgacggtggcgttgtcatgcttggcgtgcgtaccagcaaaatgcggaaggccagcatgactgagcttatcgaaatcatgttctggttcggctcagagcgcaacgtgcggtggagtgatgactcccggcgagagtatgaatggttacaacgaaaaggtagggctgcatgactatcaaatcaaatacaccagcacacgacaaggactgctggcaaacgccgctttggctttttgatgcactggatattgagtttggattctggctggattcagctgcgagcgacaaaaatgctctgtgcgctcactggctaactgaggtcgacgacgcgctcaattctgagtgggtaagccacggtgcaatctggaataacccaccgtacagcaatatcaggccgtgggtggaaaaagccgctgagcagtgcatacaacagcgacagacggtagttatgcttgtaccagaggatatgtcagtcggatggttcagcaaggctctggagagtgttgacgaagttcgtattatcactgatggacggattaattttatcgaaccatcgacagggctggagaagaagggaaacagcaaaggttccatgctgctgatttggcgaccgttcatcagtcctcgacggatgtttactaccgtatccaaagcggcattgatggcgatcgggcagggcgtcagaagggcggcatgaggcgacagcaaagaagcatcaccgacatcatctgcgaaaactgcaaataccttccaacgaaacgctccagaaatttagttttgagcagaataccatgatgtcagtgcaagggggagaaagtctcctcattatctgattcgcaatttacgtgcatatttaaatattgcacgttacaacgtgcatgtgtatgattgacttatcaatcacaacacgagatatgctcatgaaaaatgatgatgttagtgggaaggccaaaggcggtaaggcacgcgcggcaaaaatgacagcagagcaaagaaaagaatcctcaagaaaggctgttgccgcaaaaaaagaaaaagctttattgcccgtatctgcgaatgagggaaagttaaagatcggtgatgcggaattagatgtcgcggttctcgaaaatggacggcgtatcatatcacaagcttctgtttttaaagcatttggccgaccacaaagagggggtagagcacctcaagaagagggggtgatcaatatgcccgcttttatggatgctgcaaaccttaaaaaatatataaatcaagatgttatgggtgtgatcaataaggtcaaatacaagacgattactggctccgtccaggaaggttatgacgcatccataatacctcttgtctgcgatgtttatttaaaggcaagagaggcaggcgctatcaccaggccaaaccagttagagacagccaagaaagctgaaattctggtgcgctcattagctaaagtcggaataatagcgcttgttgatgaagcgacggggtaccagcgagatagagaaaaagatgcgctcgccaaaatactcgaggcctttgtcgcaaaggaaattcaaccttatattacaacatttcctgctgattattatgaagagcttttcaggttaaggggcttagaatacccgccggaaaatccccgcttccggcctcagtattttggcgttttgacaaatgatatcgtctacaagagattggcaccaaacatccttgaggagcttaaaaagcagaacgtaaaggcctcaaaaggtacaaagttgtttcaggggctgacgccaaatattggatatcaaaaattaagagagcatctgtcatcaaccgttacgattatgaagctatctaacgactattcagattttattgcaaaaatgaatcgcctgcatccaaggtttgaggatgtgaaaacagacgaactggatgattcagacaagtaacagtaacccaccttcaggtggtttttttgtacaaatccttcagagtaagtttacctccttcactgcattactactgaccattgacaacttaacaaacccagcttcggctgggttttttattgctgaattttcaatgtgagaggacatgacaatgaatgagctgataaatagcaatgccatcaaaatgacaagcattgaaatcgctgagttggtgggaagccaacacggtaatgtcagaatatcaatagaacgtctggcaaagcgtggggtgattcaacttccttcaatgcaaaaagttgaaaataaacaaacaattagccctaacaaattcacaagcgtgtatatattcgaaggcgaacaaggtaagcgaggcagcattattgtcgtcgctcagttgtcgccggaattcaccgctcgccttgttgaccgctggcgagaactcgaaggggcaaccgcgaaaataccacaaaccttttctgaggcattgcgccttgcggccgaccttgaagaccagaaggctgaactggagaaacagcttgctctcgcagcacctaaagttgagtttgccgatcgagttggcgaggccagcggaattttgattggaaactttgcaaaggttgttggtattggtccaaacaaactgtttgcgtggatgcgcgatcacaaaatccttattgcttcaggtgcccggcgcaatgtgccaatgcaggaatatatggatcgcggctatttcacagtgaaagaaacagcggtcaatacaaatcacggaatacagatatcgttcaccacaaaaatcaccgggcgtggtcaacagtggctgacaagaaagctgctagataacggaatgcttaaagtaacaggggaggctgcttaatggctaaaccagcgcgaaggaaatgcaaaatctgtaaggaatggtttcacccggcattctcaaatcagtggtggtgctgcccggaacacggaactcaattagcactcgaacgacgaagtaaagaacgcgaaaaagcggaaaaagcagcagagaagaaacgacgacgagaggagcagaaacagaaagataaactgaagattcgaaaactcgccttaaagccccgcagttactggattaaacaagcccaacaagccgtaaacgccttcatcagagaaagagaccgcgacttaccatgtatctcgtgcggaacgctcacgtctgctcagtgggatgccggacattaccggacaactgctgcggcacctcaactccgatttgatgaacgcaatattcacaagcaatgcgtggtgtgcaaccagcacaaaagcggaaatctcgttccgtatcgcgtcgaactgattaaccgcatcgggcaggaagcagtagacgaaatcgaatcgaaccataaccgccatcgctggactgtcgaagaatgcagggcgatcaaggcgaagtatcagcagaaacttaaagacctgcgaaacagcagaagtgaggccgcatgacgttcacagtaaaaaccattccagacatgctcgttgaggcatatgaaaatcagaccgaggtagccagaatactgaactgtagtcgcaacacggtcagaaaatacactggcgataaagaagggaaaagacacgctatcgtcaacggtgttcttatggttcaccgcggatggggtaaagatactgatgcgtgatatccggcaggttcttgagcgctggggggcatgggcggcaaataactatgaggatgttacatggtcgcccattgctgccggatttaagggactgatccccgaaaaagtaaaatcacgtccacagtgctgtgacgatgatgcgatggtgatatgcgggtgcatagcccgcctttaccggaacaatcgcgatctgcatgacttgctggttgattattacgtgttgggggagacgttcatggcgttggcacggaaacatgggtgctctgacacctgtataggtaaacgccttcacaaagcggaggggattgttgaaggcatgctgatgatgctgggagtgaggcttgagatggatcggtatgttgagcgtgaattgccgggagggagaacctctgtattttatcagcgaaaaaatagtttacgatcgtaaaaatctgcatatcatgataagagtggttacattgccacgcagtcgaacccgccgatgcgcgggtttttttgtaccccgaatcctgtgagctatacggaaagtacacagaaaggaaggtgcgaccgtaattaataacaaaatcttaaaaatcgcatatagcactattagttttctaaatattgtatattttaagtattgcaggataaccctgtaacgaagtttgcgtaacagcattttgctctacgagtttgccagcctcccccagtggctggcttttttatgtccgtagcgtcaaagcagcaatggcgctagggcgtcgtgcaattggcgttgagctggagagcgggcgttttgagcagacggtcagggaagttcagaatgtagtcagtcagaacggatgatattgcaggattagttacgtaccgttattatcctgcgcccggccctttagctcagtggtgagagcgagcgactcataatcgccaggtcgctggttcaaatccagcaagggccaccatatcacataccgccattagctcatcgggacagagcgccagccttcgaagctggctgcgcggggttcgagtcctcgatggcggtccattatctgcattatgcgttgttagctcagccggacagagcaattgccttctgagcaatcggtcactggttcgaatccagtacaacgcgccatatttatttaccaggctcgcttttgcgggccttttttatatctgcgccgggtctggtgctgattacttcagccaaaaggaacacctgtatatgaagtgtatattatttaaatgggtactgtgcctgttactgggtttttcttcggtatcctattcccgggagtttacgatagacttttcgacccaacaaagttatgtctcttcgttaaatagtatacggacagagatatcgacccctcttgaacatatatctcaggggaccacatcggtgtctgttattaaccacaccccaccgggcagttattttgctgtggatatacgagggcttgatgtctatcaggcgcgttttgaccatcttcgtctgattattgagcaaaataatttatatgtggccgggttcgttaatacggcaacaaatactttctaccgtttttcagattttacacatatatcagtgcccggtgtgacaacggtttccatgacaacggacagcagttataccactctgcaacgtgtcgcagcgctggaacgttccggaatgcaaatcagtcgtcactcactggtttcatcatatctggcgttaatggagttcagtggtaatacaatgaccagagatgcatccagagcagttctgcgttttgtcactgtcacagcagaagccttacgcttcaggcagatacagagagaatttcgtcaggcactgtctgaaactgctcctgtgtatacgatgacgccgggagacgtggacctcactctgaactgggggcgaatcagcaatgtgcttccggagtatcggggagaggatggtgtcagagtggggagaatatcctttaataatatatcagcgatactggggactgtggccgttatactgaattgccatcatcagggggcgcgttctgttcgcgccgtgaatgaagagagtcaaccagaatgtcagataactggcgacaggcctgttataaaaataaacaatacattatgggaaagtaatacagctgcagcgtttctgaacagaaagtcacagtttttatatacaacgggtaaataaaggagttaagcatgaagaagatgtttatggcggttttatttgcattagcttctgttaatgcaatggcggcggattgtgctaaaggtaaaattgagttttccaagtataatgaggatgacacatttacagtgaaggttgacgggaaagaatactggaccagtcgctggaatctgcaaccgttactgcaaagtgctcagttgacaggaatgactgtcacaatcaaatccagtacctgtgaatcaggctccggatttgctgaagtgcagtttaataatgactgaggcataacctgattcgtggtatgtgggtaacaagtgtaatctgtgtcacaattcagtcagttgacagttgcctgtcagactgagcatttgttaaaaaaatttcgcatggtgaatccccctgtgtggaggggcgactggtgaaaaatccttgcttgtgattcattatcgacacgggttcggtggtaccaggccgaactcaccgggaggcacccggcaccatgcagtatacagagattaggcatataccaaggcctctcatagcaggggcctttttacatgtaaaaaagcccgagtgggttcgggcaattgcatgagatactcgttttaataatcgaaatcattttaaccaggattcataaggctgcgcaactgcgcggcctttttcgtatttcgggctgtagtcttccttctgccattgtcctgtaacttccggacttcagcccgctccttattttactcacaatattatcccggccgggaggattcatggcatttaaacactatgatgttgtcagggcggcgtcgccgtcagaccttgcgaaacgaataactcaaaaactgaaggaagggtggcagccttatggtagtgcgctgatttcgacagctggttatggtgcggagttcatccagccagttgtgagtgaggggagcatctcatcaccagaggagccaggcaaccgtccgacgacctcagcgccttctgttgcgccagaatattactatgtgatcgcgcttgctggtcagtccaatggtatgtcatacggtgagggactgccattgccggatacattcgacagccctgatccacgtattaaacagttagcgcgtcgcagtacggtgacaccgggcggtgcagtatgcaaatataacgacatcattccggcggaccattgtctgcatgatgtgcaggacatgagccgtcttaaccatccgaaagcggacctgtcaaaggggcagtacggaaccgtggggcaggggctgcatatcgccaaaaaactgctgccgtttataccggcgaatgcgggcattctgctggttccgtgctgtcgtggtggttcagcgttcaccaccggagccgatggcacatacagtgacgcgagtggtgcctcggagaattcaacccgctggggtgtggacaagccgctgtataaggaccttatcggtcgaacaaaagcagcactgaagaagaatccgaaaaatgtgctgtttgccgtggtgtggatgcagggggaatttgattttggcggtacgccggtaaatcacgccgcacagtttggtgcgctggttgataaattccgtgcagacctggcggatatggcaggccagtgcgtcggtggctctgctggcggtgttccctggatatgcggggacacgacgtatttctggaagcagaagaacgaatccacgtaccagacggtgtatggcagctataaaaacaaaacggaaaagaatatccatttcgtaccgttcatgacggatgagaacggggtgaatgtgccgacgaacaaaccggaagaagacccggacattccgggtatcggatattacggttcgaaatggcgtgacagctcagccacctggacgtcacaggacagggcgagccatttcagttcatgggctcgccgcgggattatttccgaccgtctggcaacggcgattttgcgccatgcgggaagagtggcgctaaacgcgggggcatcatcgacagtatcagaggtgcgcccgtcatcgccttccggtgcagaagccacaggcgtcacaacactgctctcttaccttgccagcgagtcagagggaagcctgaaagtacagggatggtcagccagtggcggcagggcagaagtggtcagcgatgcggagggaaccggaggtaaggcagtgaagctgaccaaggaagccggtaaaagcagctgggtgctggagtacgccgcgggcaacggtgcggctctgttacagaaaggggggcagattcgctgccgctttaaggtttcgggagcgctggctgcgaaccagtatgttatggcgttttactggccggtatcttcactgccacagggcgttgccctgaccggagacggggggaataacctgctggcagcgttctacatccagacagatgcaaaagacctgaatgtgatgtaccacaatgcgaaagtggcgacaaacaacctgaaactgggaacctttggcgcatttgataacgaatggcatacgctggctttccgctttgccgggaataacagcctgcaggtgacgccggttattgatggtcaggatggcacaccgttcacgctgacgcagtcaccggtcagtgcctttgcggcggataaactgcatgtgacagacattaccagaggtgcgacttacccggtactgatagacagcattgcggtggaagtgaacagcacagacactgcggcatgataaaaaaaccgccagcgacaggaatggacgctggcggtggtgatacctatggagaaaaaataaaggaacgatactttcgtactctggtttttaatgaaaacagttcttattgtcaacaataacggaaagaaattatgacatttctgaaccagttaatgctgtacttctgtacggtggtctgtgtgctgtatctcctttcgggtgggtacagggccatgcgtgacttctggcgcagacagattgacaaaagggccgctgagaaaatcagcgccagtcagtcagccggaagcaaacccgaagagccgctcatttagcggcaactttcttaatcacacctttcgacgagaaaatcccatgtcagaaattacatccctggtcactgcagaggcagtgaaggacgtcctgcgctctgaagaagtccggagcgcactgaaacagaaacttcgccataacctggaagcgcgtcttgatgcagaagtggatgccattctggatgaactgcttggtgtacaggcagagccaccgactgaagcgggagataccaccgcagagagcggtgaagttcagcctgaatcaccggtcgccgatgcgactgaacctcaacccgaatcggtcatgatgctgtaacggggagtcagggccatcagtaaacagctgctggcctttttcatgttgtgagcttccggattgcgggagacggggtatgtaccagatggaaaaaatcacaacaggtgtgtcatacaccacgtcagcggtgggaacgggctactggttcctgcagttgctggacagggtttccccgtctcagtgggcggcaataggcgtgctggggagtctgctgtttgggctgctgacatatctgacgaacctgtatttcaagattaaagaagaccggcgtaaggcggcacggggagagtaagctgatgagcaggaaactccgctatggtttatcggctgccgttctggcgctgattgccgcaggtgcttctgcgcctgaaatcctcgaccagtttctggatgaaaaggaaggtaaccacaccacagcataccgtgatggtgcgggtatctggaccatctgccgtggagccacccgggtggatggtaagcctgttattcctggcatgaagctgtcgaaggaaaaatgcgaccgggttaacgccattgagcgtgataaggcgctggcatgggtggagaaaaacatcaaagtgccgctgaccgaaccccagaaagcggggatcgcgtcattctgtccgtacaacattggtcccggtaagtgtttcccgtcgacgttttacagacgaattaatgcaggtgatcgaaaaggtgcctgcgaagctattcgctggtggattaaggacggtggcagagactgccgtattcgttcaaacaactgttacggtcaggtatcccgtcgtgaccaggagagcgcgctggcgtgctggggaatcgacagataagaagaatattttgctgaaaaatgaggtttgcttacctggacggataacacgaaatcctgcaaattggcaaaatgtaagtgaataaagtcaaaacagttgtttaacactcaggcaccgtaatgatgcctttgtcatttctgcgcatctcacgcgcatctcacaacacagaacctttcaggatgacccttgaggataccggtttggctgtcggtgcctttctgtgggctggattcctgtgagacaaggttcatcactaaaaggaaataaccgatgaatatgatggccgtgccgtttcacggcaactctctttatgtagttaaccataatggcgaaccatacgttcccatgaaacctgtcgttgcggggatggggctggcctggcaatcacagttggctaagttaagacagcgttttgcgtcaactataacggaaatcgttatggttgctgaggatgggaaacaacgcaatatggtgtccatgccacttcgaaaacttgccggctggctacaaaccattaatcccaacaaagtaaaacccgaaatccgcgataaggtcatccggtatcaggaagagtgcgacgatgttctttacgagtactggacgaagggttttgtcgttaatccccgtaaaatgagcgtgatggaagaactcaaccaggcttgtgctgacatgaaacgggataaaaacattgccagtgtgtttgctaccgggctgaatgagtggaaacaggttaaagccgcgcatgtatcaaaaatccgtacgctggtaaatgaagcgaatatgctgattgattttgtcctggctgatacaggcaaagggaaaataacaaaggcggattgatggggtggctaatgatatcagataaactcataacgctggtgaagagcctctgtgtacttgtcggcatttcatttttagtcatgctggttgccattttcttttccaccgcctggcgagtcctgacgttatcgggactggtggggtgaaagagagatgaaccgtgttctgtgtgtggtgattattgtcctggcggttggctatggtgcgctgtggctggcaacaaaccattaccgtgacaacgcgctcacctacaaagcgcagcgcgataaaaaagccagagagctggaacaggcgaatgccaccattactgacatgcaggtgcgccagcgtgatgttgctgcgctcgatgcaaaatactcgagggagttagccgatgcgagagctgaaaatgaaactctgcgtgctgatgttgccgctggtcgtaagcgcctgcggatcaacgccacctgctccggtaccgtgcgtgaagccaccggcacctccggcgtggataatgcaaccggcccccgactggcagacaccgctgaacgggattatttcatcctcagagagaggctgatcactatgcaaaaacaactggaaggaacccagaagtatattaatgagcagtgcagatagagttgcccatatcgatgggcaactcatgcaattattgtgagcaatacacccgcgcttccagcggagtataaatgcctaaagtaataaaaccgagcaatccatttacgaatgtttgctgggtttctgttttaacaacattttctgtgccgccacaaattttggctgcatcgacagttttcttctgcccaattccagaaacgaagaaatgatgggtgatggtttcctttggtgctactgctgtctgtttgttttgaacagtaaacgtctgttgagcacatcctgtaataagcagggccagcgcagtagcgagtagcatttttttcatggtgttattcccgatgctttttgaagttcgcagaatcgtatgtgtagaaaattaaacaaaccctaaacaatgagttgaaatttcatattgttaatatttattaatgtatgtcaggtgcgatgaatcgtcattgtattcccggattaactatgtccacagccctgacggggaacttctctgcgggagtgtgcggggataatcaaaaacgatgcacaccgggttttctcatttttcacgagatgggagcgatttcccgcgaagccgcctgtccggtgcggtggtggaagaaaccggataaaacaaccgcattgtgcaaatatcgatcaaatatggtgctgctgtgtgaaatctgaaaaatcacagcggtcattatgcatcagtttttaacacaggacgtcagaacgtgacatggcaaagctggactggaaaaagctggagcaggcattccgacgcgaacatgccgaaacgggaataacattactggactggtgccggaagaaaaagattaattacaacaccgccagaacccgtataaaaatgggcaaaatcgatcatgaaattgatcataaaaccgatcatgaaatcgatcatgacatctcagatgaagaaccctgcaatgacgcgggttccggcgatgaaaaatgtgcaaaaaactctgaaaaaaactgcgcaaattcggcagaaacgaaacggattcgtggttcccgacttttaccaccttcaaacgctttttctcagcgaaacacccacgccgtaagacaccgtggatatgcgaagtatcttgaggcagataacctcatggatgatgcgtccgacatggtgctgttcgatgaactggtgttcacccgggcccgcgcactttcagtaactaaggcacttaaagggatgttcgccgacctggaagaggcaactgacgtggaaacccgtgttgctctttacgacaaaatactcaaagctgaacaggcccttgaccggaatattgcccgtatcgagtcaattgaacgctcattgctgacgctggacgtcctggctgagacagcaccaaaacttcgtgctgaccgggaaagaatcaacgccgccagagataaactcagagctgaaaccgatattctgaccaaccagcgtcggggcgttgttacgcctgtcagtgacatcgtgtcatcgctgcatgaaatgagtaattcggggagactggatgacattccggaagaatgaaccgcgatgtgatgagccgtcagaaatgaccgaggctgaacaacgtctgttcatcatgactaaactgagcaatccctggtggcggctcaatcatctctacaaaatacagaacgaaaaaggtgaactggtcaccttcagaatgcgaccggcgcagcgccagttgttccggagcatgcacaataaaaatattatcctgaaagcgcgccagctgggattttccacagccattgatatttatcttctcgaccaggcattattcattccgcatctcaaatgcgggatcgtcgctcaggataaacaggctgccagtgaaattttccgcacaaaaattgctgtaccgtttgatcatctccctgactggctgagagcctcattcaccatcgttgaacgtcgtagcggtgccagcggtggctatatcctgtttggtcacggctcgagtatccaggtggcaacctcattccgttcaggtacggtgcagcgcctgcatatctcagagcacggcaaaatttgcgcgaaatatccggctaaggcgaaagaactgcgaaccggtacgcttaatgccgtctctgatgaatgcattatttttgatgagtccactgctgaaggcgtgggtggtgatttttacgagatgagtaaccgagcacaggagatcactgcatcaggcttattgctgacggcacaggattataaattccatttttacgcctggtggcaggatcctaaatacagcgccagagtgccggaaagcgggctgaagctgtcacgggaaaaaatgacgtatttttctgcggttgagaaggcaatgaacatcacgcttactgatgaacagaagcagtggtacatcaataaggaaactgaacagcgtgaggaaatgaagcaggagtttccctcaacgccacaggaggcgtttctgacgtccggacgacgtgtgttcagtgccgaaagtacgttgcaggcagaatcattctgttcgccaccgatgattgtttatgacattgaacctgttacaggagcgaagactaaagctcagtctctgcgtgaaggaaataaaaacgagttgcagcggacgctgatgaattatctgctggtatgggaactgccggatccggatgaagagtatgtttgtggggcagatactgccgaagggctggagcacggagaccgctcatcgctggatgttgtcaaacgcagtaatggcgagcaggtggctcactggttcgggcatctcgatgctgaactttttgctcatctcatttcgcaggtctgtcgtatgtataacaacgcgtttgtggggccggagcgtaataatcacggacatgcagttatcctgaaactccgggaactctatccgacacgttatatctacaacgaacagcatcttgaccaggcatatgacgacgatacgccccgccttggctggctgacaacccgtcagagcaaacctgttctgaccgaaggaatgaaaacgcttctgaataatggaatatcagggatccgctggtcaggcacattatcggaaatgaacacctacgtttatgacgcgaaaggctccatgaatgcacaggaaggctgctttgatgatcagctcatgagctacatgattgcccaggagatgcgcgccagaatgccggtgagggtaaaacagaaaacggataaacgcagaaccacacactggatggctcactgatgaaaaatgaaactaacaccatggcgacgaaaaacgacaatggagccacgccgcgtttttctcagcgccagttacaggcgctttgttctgatattgacagccagcctaaatggcgtgatgccgcaaacaaggcctgtgcgtattacgatggcgatcagttgccaccggaagttcttcaggtactgaaagatcgcggtcagccgatgactatccataacctcatcgcgcctaccgtcgatggcgttctgggaatggaggccaaaacacggactgatctggtggtgatgtcagacgagccagatgatgaaactgaaaaactggctgaagctattaatgctgaatttgccgatgcatgccgccttggcaatatgaataaagcccgctctgatgcctatgcggaacaaatcaaggcgggcctcagttgggtggaggtcagacgaaacagcgatccgttcgggcctgaatttaaggtgtctactgtcagccggaatgaggttttctgggactggctgagccgggaggctgatttaagtgactgccgatggctgatgcgtcgccgctggatggataccgatgaggcaaaagctacattcccgggaatggctcaggttatcgattatgccattgatgactggcgtggttttgtcgataccacggttactgaaggccagcccagtccgttgatgagtgcatgggaagagtatcagtcatgggatcgacagcagaacgaatggcttcagcgtgaacgccgtcgtgtgctgcttcaggtggtttattaccgtacattcgagcgtcttccggtgattgaactcagtaatggacgggtggtggcctttgataaaaataatctgatgcaggcggtagctgtggcatccgggcgggttcaggtgaaagtcgggcgggtaagccgtattcgtgaagcctggtttgtcgggccacactttattgtggatcgcccctgtagtgctccgcaggggatgtttccgctggttcctttctggggataccgaaaggataaaaccggggagccatacgggctaatttcccgcgccattccggcacaggatgaggtgaattttcgtcgtatcaagctgacctggttgcttcaggccaaacgcgtgattatggacgaggatgccacccagttgtcagacaacgacctgatggagcagatcgaacgtccggatggcattattaaactgaatccggtccgaaaaaatcagaaaagtgtcgcagatgtttttcgggttgagcaggattttcaggttgccagccagcagtttcaggtcatgcaggaatcggaaaaacttatccaggataccatgggagtgtattccgcatttctcgggcaggattcaggtgcgacgtcaggcgtggctatcagtaacctggtggagcagggggccacaacccttgcggaaatcaacgataactaccagtttgcctgccagcaggtgggaagactgttgctggcttatcttctcgatgacctgaaaaaacgccgtaatcatgcagtggtgattaatcgcgatgatcgccagcgtcgccagaccattgtcctcaatgctgaaggtgataatggtgaactgaccaatgatatttcaaggttaaatacacatattgcgctggcgcctgttcagcagacaccggcgtttaaggcacagcttgcacagagaatgtcagaggttattcaggggctgccgcctcaggtgcaggctgttgtgctcgacctgtgggttaatcttctggatgtgccgcagaaacaggagtttgttgagcgtattcgtgctgcgctggggacgccaaaatcaccggatgaaatgacgccggaagaacaggaagtagcggcacaacaacaggcacttcagcaacaacaggcagaactccagatgcgcgagatggctggcagagtggcaaaactggaagctgacgccgccagggcacatgcagctgcacaacgggataatgccagtgcacagcgggaagtcgccctgacacaggggcagcgttatgtggatgcgcttaaccaggcacatacggcagaaatcattaccggcgtacagaatatggaacaggagcaggacgttcttcagcaacagatgctgtatacgttacaacagcggatgaatgaaatgtcgctctgaaaactctggcttcaactgaaccccgtcatcgtacggggttttttgtttccggaggtaagcgttccgggagcggtgcgcttattcgcgggggcagcgataagccttatttactcaaccattcggatctgtccgataaacagaccatgcggagttatttatggattttgaatttacgggtgaagaaaccccggaacaactggaaaaaatgctggaaggacttggggatgtggatattgacagtcacgcacaggacgtcgtgacggaagataccacggaaaaacatgcggatgaggaagcacagactcagacgggcgataacaatgtggcaccgacgccggatgccagtgtggagcagacgcaggacgtgaaggagccggaagcgaagggggtgctcacccgcgacggtaaacacgtcattccctatgaagtccttgaggctgaacgttccggtaagcaacgggccgaacaggaagccgcacttcttcgtgggcagatagctgaagaaaaacgcagggtggaactgctgacgtctcagatccaccaggccggtatgaagcccacaccgttaccggaaaacgaaaaaatttctgatgagcagattgcccgtatcagggagatgtatccggaaattggtgacgcggtggcttcgctcatccgtaaaaataactatctccagtcccgtgttcagcaatcagcacagcaggcagaaggtaatggtggtgaggatttatcaccggttcttgatgcgatgaatgccgtgccggtgctgaaaacgtggcaggagtccgatccagatcgcttctcggttgctgtatccatcgacgggaagctccagaatgaccccgcatggaaagacaaaacgctcactgaacgtttcgctgaagtggcccgtcgtacgcaggttgctttcggtgaagtcagtgagtcgtctgctgacaacaaggcagacaaaacggatatccggaaaacggcggaagagaaagtgaagaccgctgaacaggagcaggcagtacctgcttccccgtcagatttaggcaccacggcttccgtcggaaccggtgataattttgaacggttacttggcgcttctcattcagaggcagaggcgattatgcgcggtatgacgaatgctgaaatagacgcgcttctggagaagctcgggtaacttactgaaggagaactgaagtaatgacgactgtaacatcagcccaggcgaataagctgtatcaggtggcgctttttaccgctgccaaccgcaaccgctcgatggtaaatatcctcactgaacagcaggaagcgccaaaagcggtttcgccggacaagaaaagcacgaagcagaccagcgcgggtgcgccggttgtccgtatcacagaccttaacaaacaggccggtgatgaagtgaccttcagcatcatgcacaaactctcaaaacgtccgacgatgggagatgagcgtgttgaaggtcgtggtgaggatctcagccatgctgacttctccctgaaaatcaatcagggacgtcacctggtggatgcaggcggacgtatgagtcagcagcgcacgaagtttaacctggcatcctcagccagaacgcttctggggacgtactttaatgacctgcaggaccagtgtgcgatagtgcatcttgctggagctcgtggtgattttgttgctgacgacactattctgccgacagcggagcaccctgaattcaaaaaaatcatgatcaacgatgtactgcctccgacacatgaccgtcacttttttggcggtgatgcgacaagctttgagcagattgaagcggcagatattttttctattggcctggtggacaatctctccctgttcattgacgaaatggcgcatccgttacagccggttcgtctgtccggtgatgaacttcacggagaagatccatattacgtcctgtacgtcacgccgcgtcagtggaatgactggtacacctcgacgtccggtaaggactggaaccagatgatggttcgtgccgtgaaccgtgcaaaaggttttaatcatccgctgttcaaaggtgaatgtgcgatgtggcgcaatatcctggttcgtaagtatgcgggtatgccgatccgtttctatcaggggtcaaaggttctggtatcagagaataacctgacggcaaccacgaaagaggtcgctgctgcaaccaatattgaccgcgccatgttactgggggctcaggcgctggcaaatgcttacggtcagaaggcgggcggtcacttcaacatggttgagaagaaaacggatatggataaccgtactgagatagcaatcagctggatcaacggtctgaaaaaaatccgtttccccgagaagagcggcaagatgcaggatcacggcgtgattgccgttgatacagcagtgaagctctgattttttcctttccctatgccgggttttcgcccggctttttcaggagtcattaattatggcaaagactatccttgccccgtcactgagtgaacgggtctatacgggtacgcacggtaatgagtcggtggcagaaggcgtatttacggtgaatgctgcggaagcggacagtgttattcatcttctctcactgccagtgggcatccgtatcaactcactccaactggtttcaacgggtggtctgggtactgcaaccgtcagcattaagtccggtgagcatgctctcatcgataacagcgaagctgtttctgcaaaatttgccagatatgtgccagtggagccgtacaccacacagcgtgacggggagctggttactgtcaccattaagactgccgctgcaaccggcaccctgaatgttctgctgcgttataccgtggtgggatactgattaaaaccttccggcccgcgtcatgcgggctttttatccggggaattatatgagtgagaaaattgccgttgtctatatcggcccaaaacccgtgaaaaaggacaccattaccggaagtcgcacgctgttcccacgtcttgagccggtgcatgttgacagcgcgatggcctggcaactgctggggtttccggatgtctgggttcgtcatgaagagcttgatgatgttctgaaaaagcaacaacagaatgagcagttgcggcaggcacagcaggcgcaggaaagagtgcttgctgcgctggcagaagcggagaacagttttgttgtttctgttaacgggcaggaggtggatttaagtaagctcacctcagcacggctggcgacgctgtgtgaggcagaagagctggatattcacaaagacccgaaagaaacggctgaggcattccgtatccgggtgcgtgaggcatttcgccgtcgtgttgcggagactgaacagcatggcggaactgagtgattttttaccgtatgtccgtcgtcatatcagcggtccactgaacattatgatgacggatgctctgtcaatggctgccgtggcattcagccgccagtcgttggtgtgccgtcgggaggttactgttgtaccagtagcaggaaaagaaatcgtgcttccgtatgacaaagatgatgaggagtgcgttcatatcatccgtatctctgacgataatcatgagctttttgtcggtcgggatgtggatatcagctccggacgctccctgcgatttgcctgttctcccggtgaggtgagcgtgctttatgccgtcgctccgaaagccggacgcagccagataccggatgaactcctcacatggcctgaagaagtggctgcgggggcacttgagcggttgttcatgcagactggtgtttcatggtcagatccgttacgcgcacagtatttttctgtgcagttttctgaggggatccgtcgggcatatcgtcatacactggcgacaagcccgtactcttcataccgcaaccctgtacgcaggcagaggtttttctgatgacgacgattacagaaatcatcggacgtgtgaatacacaactggttgacccgatgatggttcgctggcccctgcaggaattgtgcgattattacaatgatgctgtgagggcagtgattctggcgagaccggatgctggcgcaagcctggaaacaataagttgtgttcctggcgcccgtcaggttttgcccgatggtgtaatacaacttcttgacgtgatatgcctcagtgacggtagtgcagtcagaccattatcccgggaggtgctggatgcgcagtatcctgagtggcccacaatgaagggtattcctgaatgttttatcagcaacgacctgtccccgcgcgtattctggctgtttcctgctcctgacaaagagataagtattgatgcagtggtaagccggataccggaggcagtgtatgttctgacgcaggacgatgatacgccagttccactggaagaggcttatgttaacccactggtggagtggatgttgtttcgcgctttcagtaaggatgctgccggtggcgcagaatcggggctggctgcgcagcattatcagagttttgttgagcaacttgggatcaaacagggggcagacagtgcattgtatgcccgtaaaaaagtgtttaacggaggtggagtgtgagtgttgttgtttcggggacgctgaaatctcctgatggtgaggcgatatcaggagcaaatattaccctgacggcgctgacagtttcaccggatgcgctcagcggcaccagtgcgtcggcagtgacccgtgaaggtggatattacggaatgacgatggatccgggggagtatgcggtttcggtgacggtgaaagggaagactgctgtctacggacgtgtgcgtattgaggggaccgaaagtacggtgacgctcaatatgctgttacgccgcagtcttgttgaggttagcatacccggagaactgctgacagatttccggcagatacagaataatgtggctgatgaccttgccactattcgtcgcctgaatgaagacacggcgacaaaaaacactcaggccacacagtcaaaagaaagtgcagcagccagtgcgaagagtgcatctgacagtgcaaagacggcaaccagcagggcggctgaagccggacaaaaagcgactgatgccactgaggctgcgacccgtgcagtcacagcagcggggaatgcagaggaaagctcgacccgtgccggagagtctgaaaaagccgccggagctgatgcagaaaaagccagacagcatgctgaaaaggccaggctggcgcaggagagcgccggagagatccttaagcgggcagaggctgccactgtcagtgctgaagaggccagacgtatggctgagaatgcacgggggccccgggggcctcagggagaaactggtccgaagggggatgtcggtcctaaaggcgaaacaggtccagtgggccctcaagggcccgcagggccgaaaggtgagcgtggtgacgttggtgctcagggggctgtagggcctgctggtccgcgtggtgagaagggcgaacagggggagcgaggaccgcagggaataccaggcctgaagggggataccggagagcgggggcctaaaggggaccagggggatatggggccaaaaggcgagaaaggtgatccgggaggtcctgcaggcccgcaaggtcctaaaggcgaacgaggagaagccggaccacagggaccgatgggagcacgaggtgagcgtggggagactggcccccgaggtgaacctggtcctgcaggtccgagaggcgaacgaggagagaccggacctcagggacctcgtggagagccaggtccggcaggcagcgctgcaaatgtggctgatgcaacgacggcacagaagggaattgtgcagttaagcagcgcaacggacagtgatgatgaaacgaaggctgccaccccgaaagcggtgaaagcggcaatggatgtggcaaatgaagcgaaaacaaaggcagaagaggctgcagcaggaggtggtgttcccggtccgaaaggagataaaggggacacggggccagcaggtccggctgggccgaagggtgataagggagagcgcggtgacaccggccctgtcggggcaaccggcgaacggggaccggcaggtgatgctggtccggcaggcccgcaggggccgaaaggtgacaggggagagcggggagagaccggtctgacgggaaatgcaggtccacagggtccaaagggagataccggtgcggcaggcccggcaggcccacagggaccgaaaggagaaacaggtgcggcaggcccggtgggggcgaccggacctcaggggccgaagggcgacccgggggagacgcaaatacggttccgtctggggccgggaaacattattgagacaaacagccatggctggttcccggatacagatggcgcactcatcaccggactgacctttcttgaccccaaagatgccacacgggttcagggtttttttcagcatttgcaggtcaggtttggtgacgggccgtggcaggatgtcaaggggctggatgaagtgggcagtgatacaggcagaacaggagaatgacatgaatattttgagaaagcttatgcagagtctgtgcggttgcggaaagcatgatgactgtgaaaacgggcagtcgcttacagcacaactgcgactgggaccggcagacattctggagtcagatgagaatggcattattccggagcaggacagggtaatcacacaggtggtgatactggatgcagataaaaagcagatacagtgtgtggtaagaccgctgcaaatcctgcgtgctgacgggacgtgggaaaatattggcgggatgaaatagccgacagcttcacaaaaaccggagcccggctccggtttttgttgtcatgtataggggggggttattagagagtgaagtaataaacatgttaatacgatggagtgaaggatgccgtgtaattctggttcaagagttttttatgccggaaaatcgcaggattattctggatagtaaagaatcctggttaataatctgtgatagtcagttgggccatttaatgcgcagtatgtatcagggacgccgttttattcagctgaatctggaaaaattgaaaggggtacatgatgtcgccttgccagtgaaatgggaattcacacgaagacagtgaatagctttctgtatacgggaatggcgaaaaatggactgtatggtgtgagtgtgaaacatcttgcgtgtgcggagtgatgcttctcgttgctacagcggcaatgataatgcagtgaaaaaaggggagcaatatgctcccccaaaccgaaagaaaattgcaataatcaatgaagttatttagtcatcatcagaatgtcatgcaaggcattttgtttcagtgatgccgatcgcgattttagcgaattccatcataaatcccctgatttttaagcctgaagcagtcaaaggaatttctatgccctatatcgatatcaccacgatgcgtgggatgatgccgcgcgttgtgacatccatgctgcccgagcattccgctgtactggcggaggactgccatttccggtttggtgttattacaccagaacgtcagatatccggggttgagaaaacattcacaattaagccaaaaacaatttttcattaccgtgacgatttctggtttgcatggccggatgtggtggatgtgatccgcagtccgatcgctcaggacccccacgggcgtatttactacactgacgggcgttttcctaaagtgacggatgcgactattgccacaaaaggggacgggaatcacccgacatcatcgtatcgtctggggatccccgcgccgacgacagctcctgtctgtactgttcagcagggcggtgatgtttctgacgataacccgaatgatgatgaaacccggttttatacggaaacctttgtctcagattatggtgaagaaggtccgccaggtccggcgtctctggaggtaacactccgtactccgggaactgcggtacaactgacgctggctccggtgccattgcagaatgccagtattaaacgtcgccggatttatcgctctgcatcaggtggaggggaggcggattttttacttgtggctgaactggatgcatccgtgctcagttacacggacaaaataccggcgaaaaaccttgggccttccctggcgacatgggattacctgccgccgccagagaatatgacaggcctttgcctgatggctaacggtattgccgccgggtttgccggtaatgaagtgatgttttcggaagcgtatctgccgtatgcatggccggaagtgaatcgtcacacgacggcagaagatattgtagctatctgtccgctgggaacgtcactggtggtggcgacaaagggggagccttatttgttcagtggggtatcaccgtccacaatttctggttccaaaatcccttcaatgcaggcgtgtctgagcaggcggagtatggttgcgatggagggttttgtgctgtatgcaggaacaaatggcctggtgtctgttgatgcaaacggtaatgtcgcgctggcgacggaacagattgtttcaccggaacagtggcagagtcagtttaatccggcctccattgtggcttatccctggcgtggtgaatacattgcctgttacacgaaaccggatggtaagcaggatgtgtttgtattcagtccggtgaacatggatatccgttatctcagtacaccgtttgactgcgcatgggttgatctcgcgaaagatatgatgcgcgtggtgacaggagacaaaatgtcagtgcttgccgggggggctctgccctccacgataaggtggcattcaaaaattttttcattacctgaaagaacctctttttcctgtatcagggtgaaatctccggcgcctgagcgggtggggatcaccattatggctgatgatgttcctgtgattcattttgcgccgggtacgtttaagggaagtgtggtgagacttccggcagcaaccgggcaaaactggcaggtgatggtatccggattcgggcaggtggaacgaataaccctgagtacatcaatgtcggagatgccggtatgaccagaaaaccgtggcgtgcggggaaggatttatccactgttgtggagaatatggaaattggcaccgggcagcgtggtgacggacgtcacgcatttgtgacccgtgaggaactggttggtcttaaactcgcccggcgtcgaacatcgggtggtgcctcatatgcactgaatccgggtattgagattgacagtactttaatgactgttgattttcccacaaaaccgctgaattttaaggcgaccggtggatttggctcggttcttcttgaatgggatatgcctaattatcgcggacattcactgactgaaatctggcggggtacggaggatgaccttgctgatgcagtgctggttgccacgacgccggggcaggtttacggcgatccggttgaccctggctggtcgggattttactggatacgttttgttaacgcggcaggagtgaaaggtccatggaatgctgaaaaaggcactcaggcacaaacacagatcggcgtgaaggccatcattgaccagatccgcgatgaggctgcaaagtcgccggttgtgtccgagctgcgtaaagaaataaaaaacgcgcaggggcaggctgtaaaggatgctgcaattaagacaaccgaagttgtagggactctcagggaagaaacgacaagaacgattggtggtattgaaacccgcattagcacactggattcgtcaaccagtgaatcgcttaatgaggtcgacaagcgcatcactaaattggataaagaaggcggtgaagcttttcttgcaatgtggtcaaaaaaagcgggagttgatggtatcactgcggggatcgggattgtcgccggaaaagacagtgaaggcaggcctgtaagtcaggttgcaatttctgcgtcgcagttgtttgtctttgacccgaataatccggataacacagcctatccgtttgcggtatcaggtggcaaggtagtgatcccgaaagcgatgatttatgacgcggtgattgaaacactggtgtcgcggaaggttgtggcggatgaggtaaaagccggggtaagtatcacttcgccagttatccggagtgccgttattcagaacggaaactttcaggttgattctcagggtaacctgaatattggaggccttttcagtgttacgtcacaagggcaactgacaattcgttactctaatcagaatgtaggactggtgatccgcaatgataaaattgaggtttatgaccagaatggacgactggctgttcgcataggcagattacgctgatcaggaggtgagtattggaatacggttttgccatttataacagaaataacgttaatgttacgggcgtgctgactccagtatttttcctggacagatttacagcggagtctggctcaaagacgtacactaataaacccgacgggaaatcattgcaggctgtatgttgtttatttccctggaataatgtatttgcggatcggaaagtaccgaagataaccattaatgacaatacggtgacgtggtcgaatcttgagcagggtatgggatcttatatttatacattctggggataagtgttatgtacggtttgagcattatgaagccggatggcagcgtatggataagtccaggttttacgccgcagtgtctgatcaacaaaggcaccataccggcgactgaaaagtctttttttaaaacatcaatcccgtcaggcaaaagttgttttttctttatcagaacagagaagaaggccgatgtcatgtacacgcatgaacagattgatggatatcatgcactaaggcttcatgtaattgtcaggggaacgaaccctggtgttacgacggtttatgctttcgcgaatatggttactccaccttctgagtatggtatcgccatgtataacccggacggtgagatgatttatcatggcgaaatgatgctgcttgacgcgaagttaatacctgttgatatcaaatttgaaaaggaccttggatatccatgcgcaatcatgcctgcactggtcgggtattataactggaaaagaactccttatgatcgaccgatttataccacatccactggtgctacaggaaataaaatatattcctgtgagcattattccggtggtgcaacatgggatattcgaaagccgtatatagataaggtcctggttattaatacatcagtatatgattagttgaagcgagtctttaatattcatttaaaatgtctaaaaagatgtattattaaaaagtttagcgtgttatctgaatacaggatatcttaaatgaagagtatagcaacactggttgtgtgtgcaatctccgggattgcctgtgtaaatttatctgcacatgcagcagaaggagagcatacaatttctctggggtatgcgcactttcagtttccgggactgaaggattttgtaaaggatgcgactgctcataacagggagactttcagtcatttcgtcaacagaaactacttttcttcattgggcgaatatacagatggtcgggtcagtggatatgaaggcaaggataaaaatccacagggcattaatatcaggtatcgctacgagataacggatgattttggcgttatcacctcttttacatggacgcgttctctcactaactcacagacatttattgatgtgcagtcagccgatcataccaggaagattaagaatccggcagcttctgccagaacggatatcagggcgaattactggagtctgttagcggggccttcatggcgggttaatcagtacatgagtttatatgcgatggcagggatgggcgttgctaaagttagcgctgacctgaaaattaaggacaatattaacagtagtggcggattttctgaaagcaacagcacgaaaaaaacctcccttgcgtgggctgcaggtgcacagtttaacctgaatgagagtgttacactggatgtggcttacgaaggttccggctctggcgactggcgcacgagtggcgttactgctggcattggcctgaaattctgacctgtatccggtaaccgtttactacccgctgtgatggcgggttttttattgcccgtacagggcaaaaaccgtaaattatgcgtgggtgcctttcggctgatggctggagggtgaacctgaaggcctgatgtggaaaggccccgagtcaacttaacgttaacccgaggccctaacacttcgtaccttaagcaagtagaaggttagcgcctctctgtaaaaggagtcaagcgctatgtcgcaaaaatcgcttatcaccgtcacaatttgcatgacggttatcttcaccatctggatgttgcacggttcactgtgtgagttccggctgaatttgtggggagcggagtttgcggcgttcttacagtgtaagcagtaggaaaaccgcgacggggacgagagtccccgtcaactggttgctgaggttcagccgatatggcacccgtttcaggtgagagaatgaacgataaaattctctggtatatgcagcgtgttgtgagaaattcccgcaaccctgaatttatgaatgaagttaaagacgcctgccttaaaaagcaggcgttttgttttgaggcacctgatggctttttggtgctgcgttctgtgctcagtgctgatggtatcccttatgttctggtgttgctgggcgtgtgtacggggagtaacagcgttgagcgttacctgccggaggtgaagacattaacccatctggctggcggacgctgggctgagttccatacggcaaggcggggatttatccggctgggaaaacgactgggctttgagcgaatgccggatgatgaggatggcttcatggtgttcaggatagcggtctgactgctacagttttcatcattgtgtttaaaccaacattgtaattcacattctgaccctgctccggcagggttttttgttatccagggggccattatgggtggaagtaaaggcggtggtgataccaaagtaaaaccaacagcagcgcaaatagcacaggaagaagtggcctggaaagggtggcaggattacaaaaatatcctccgcccggctgaagataacttcatggaaaaggtcgatgacctgaacagtgagcagcagtacgacaatattgctggcaccacaaatctggggtatcagaaacagtttggcgaagcacggaaggagcttgcgggtaatcttgctcagtccggcgttgacccatccagtggtcgttttaatgcggtaatgaatgcgaaccagagtgaccaggtaaccgggcagattgacacaaccacacgggggcaggtatcgcaggcagataagtatgttgccgggctacaggatgttgctgctctcggttctggtcagaaggcggatgcgttacagagttttaactctctggcagacagcagtctggcaaaagctaaatcggatgcacaggcggcgtttacgaaacagcaggggcgagcctctcttgttggcgctggtctgggtgcggcaggtgcatatgcgatgcataaggctggcggtagcggaggaagtggcggtgctaaaacacctggcaccggcgctaatgccattcagcatcaggctcagaactggagactgtaattatggagtatggcaaatacgaaactctcgcaagggctggttattcaggagcagaccgcccacagggtgactggcagacgtcagcagcgctgacacgccaacaatacgacgactggcgaaccagatatttgccccgcgtggcaaggctggctgaccttggggagaacaacagtctgatgaatgcacagcttgcacgggtgggaggccttgccacttccagtctccgtacagcgcagatggcgcaggataaccagatggcgagatacggggtaaaccgcccggataatcccgacagtaatacgctggggttacgtaatgccctggcaattgctggcgcgaaaaatggtatccgtgaagccgaacaggatcgccagatgaatattctgacgggggcttctgcaccggcaagacagaaactgagtgttggcggccaactggtggcagcgtaagggggcaatatgggatacggtttactggatattgcaaatcagtcgcggcgtgaggcattacagggaataagtgacgcagacagacgacgtgaagaaattgaggctgcgaacaaacagatggcggcgcaacagaaagcgcagaacaagcagaatatcggtacgggcattggtacgggggcggctattggcgcatccgttggtggtcctgttggtgctgttgctggagcagtaattggcggcattgctggttctttgttttaaggagtggtgaatgagcggatttgcacaggggttacttgccggattcagcaccgttgaccaggcaatgacccgtcgtaaggagcttggtctgcgtgaagcacagcttgcccggcaacagaaaaataacgagcgcgattttgagtttgcgcagtctcagtttgaacataataaaaacgttgatcagcggaactttgattacagagccaaagttgacgaccgtaattatgcactgaaggagagggagtttaacgctaaccagaattaccggaatgcgtcactgggtatggagcagcagcgactccagttgcagaaatacaaccagcgacggcttgagtataacgatatgattgcccatagccagccactaatggaagcgcttggaaaagcaattgaggctggcgatcaggaggctgcaacgcgtctgttcgggcagctgccaaagggacatccattaattcttatgtcaaacgaaggctatgcagcgaaagcgggtcaggccgtgatcaacctgcaaaaaatctttggtgataagccggacatggcgatcgattcgctgaataccccggaaaatctcgatgtgctttccggcgtgtttgccccggaactacaacagcgtattggcatgcctgattcaaccggggacaaaacgataaaagaggccaggattggcagtatcgtaccagcgcagcaggaagggtacgtacttattggccttgatctcacatacagcgatggctccaccgcgcataaacctgtaacagaatacggcagtgcgcaccctgatgatcaaaccgtgctggcgatacccgttgataaggctatcgctcaggtcagggatcgcagcaaatttgcagagatatcgaaaaattatggttattttatgccgaagcagcagggactttctctgaaagagcttcagaagggggccagcaacgtagcggcggacgcgatcaagaatggcggtaatgctcaggctgcggtggatgaatattatgctgcgactggttcacaaccgcatcaacagaaaattcagcaacaaaaacttcagcaacaggttatcaactgggcgggagatgatcctgacaagctgtcatttgccagaaatgtagcggcccgtcagcctgaaatgctggaacctcagaatcagaaattgctggagaacgggtatgcgaattttctccgtattcaaaaggccaggggggaacaggccagagatgaaagtgcttcatctgcatctcagtttatccgtggactgaaacagaattacgcccagtaattcacgatattccattaataccatttcctgatgcccggccattgtgccgggtttttttatggagtctgtatggcctattcagaggaacagcgtcctgaggcgcaactcggtaaccagaatcgtaacagcctgaacattcagcaacccggcgaaactgacagctatgaagcatttttctctgatccgaatcgctggaaggataacagtacgtcgttcagcctgggcgatgtattgccaacaatgggtaaaggtttcgcccagtccgtccggggaacaggggaaatggcccgtggactcggtgatgcgatgattcagagcccggtaaaaacaggggcgcgtattttaaatgagttcagccgtatggggctgccgggtgtcgcaactgtgcaggatatttttgccggtggcagcaggggggctgatgaggtcatcgataccctgcctgatggcaaaaacgcggttactgatattgtcggtaaaggtctgaaggcaaccggtaaggctgtcagtgatggtgccaaagccactgatgaatggctgaccggtaagatgtcgccgggtgcagttcgtgcgctgaatacgccgatgaccgaaggctataatgattctgcggtctgggtggcgaagggtgtaaacctgattggtgcgcttgtacctgatatggttgctggcggtgtggctagaaaggtgggtgatgtcacactgcgaaaaatgctgaccgccgggctggagaaaaaatacatcgcggcagggatgcagccggaaagagccacggcactggcagcagaagctgtcgataaaaaaatgccggatttattccaggcgggcctgatcacccattccactgtaagtgcacaggggcagagtgcaatggcggcagcagatgctgttcttaatgctgattactctgagctggcgcagtcaccgaaatttcagcagacgtttttgtccattgacgccgacccgcagcacgcacagcttactgatcgccagaaaatggatctggcaaaagagcgtgttgccgatgaggtgcgcgcgcagctggcaaccgatcctgaattgctggctgtgaatgccatggcggcaaaactgggtgacgcacaactgtttaatctggtgacacgaggcacagcgaagaccgttaaaagcggcattgtcagaaatgccacggaacagggggcgattaatgcggcgcagggcggctattcacgctatcaggaaaacacggcattgcgtgagaccgccggaatgggtgtgtcaccgtgggagggcgtggctgacgcaacgatcgaaggtgcagcctttggtgctgcgatgggggctccattcggtgcggttgccggatatcgtggcagacgtcaggccgcagaagaaaccgccatgcgtgatgctgaaaccgtgcagcaggacgacgcagccccgcaaccagaatctgttgatccggtggcgcagcagcgtgaatccatgcagggcatgaatcgcgagcagcttctggagcagtatgctgatgcggatatggcaacagagggtgacgcatccgcagctcatcgccgggaagctgccagccagttgttgaatgaactggacgaacagacgaagcgacaggctgtgatgaatgagctgaaggcgaagccgcgttctgaactgcttgaggaataccgcagactcagccagaaagaggggcgcaccgagactgaagaacaacagtttcaggcaatacgagaagtcattcgcccacaacaggaagtgacgccggaagcacagtcacagcctgaaaatgcggaggatggtaacgggagcatttacccgacggtgcggttccgggacccgaatgaagtccgcattgaaattaacgggaatggtgcgtccagaccagcggaacgcattgagaaggtgcgcccggacaaccgttatttcacggatgagaaaagcgccatggggagtgatgttttccgtaatgccgccgccaccggcctgaaaccgtccgtagtgaagaaaggcgagaatcagtatgccgttgaaatggataatcctgcgttctctgaagatgtggcaacggaaaccattaacaccctggctgacggagagcgtattgctgatgctgacccgatggagcagcccgcgttcatgcgtgacccgcgattccgtggtttcacgggggatgatacggaggtacaggcccgccttgcccgtggcaacgcgccgacggcagaggagcttgtacgttcacagatggctgaaggtgatgccggtccgacagcacaggagttaactgagcgtccacgcctgcccgctcccggcgatattcatcccggacagggatatccgttaccgggagaagtggcgcgtacgccggatgaaaatcaggccggacgtggtggtcgttttaccacaaccggtgaggttaagggccagagtttccagaaaggacaagctccggcaccggaaaacgccgctggtcgccagggggaaacactcgagggtgacatggttcgtcgtggtctgccgtcaccggatgcgcagaacgcgacagcaccggtacgtgaagggctaccggctcctgacattgcgcgtaatgttcgtatgcctcagcctgaatcacttccccgcactgtacgggactcactgcctgagcttgcacagcaggcagaagtacgccgacaggccggaggaaatcgtgacatcccgcagcctgagacaatcgcacctgaatctgaaacaactgtctctactgacagggaagctaccgtgcgcggaggtgaagtcaggggcaaaaaaattgaagactttggtgaagaaattaagggcgcggcaaaacaccgttatgcacagcttgctgaaacactgggtaaaacgctggaagacagggattatgccacgcagccgctgagcaaactgttcccgaaaccggactacgcaaaactggcgaacgaaggtgctgatgctgataccctggcaatgatagcgctgtatcgtagcgatattccggcgaagacgaaacacaatacggcaggctggggggagagcataaaaaaagtacgacacagtgtatcggaaatgctgaacggaacggtcagcgcgaaacgcctcgcagaatggatggaaggcagaatgccctcccgttacgcggatacctggcaactgttacgcactctgccaccctcacagatggacagggcttctgcttatcgggtggtatcgggtgtgtatcaggcggcaggagggaagcgttacgatccgccacagaaactttattcactgcgcaataaggacaataaggggagtaacctctttttctcggaaagcagggatgaattactggcaaaggcgaaagtctggtttgcagagcaggaggaaaaatcacaggcgaaaggtgatgaaaaaacagcaccgtcaccggatgacaaaatccgctttgacgtttaccggaatacccgcagtggcgatatttttatcgcttacggtaaaaacaaaatgcgggtgagaggtggctttaagtcagccagtgatgcgcgtaagtacattgattcacatcgtgatgagcttgttcgtcatgtgaaggagatgcgggagatttcgcgtgaggagcagcgcaacgccaccaaccgcgaccgtaccggaccagaacgccgcaaggggaatgtttcaccggagcagttcagtgatgcgtttggtttccgtggtgtgcagtttggtaactacgtggaaggtccgcgtcgtcaggctgatttgaaccgggcttatgactcgctgcatgaccttgcggaagtactgaatgtaccgacaaaagcgctttccctgaacggtcgtcttggcctggcatttggtgcccgtggtaagggtaaggcggcggcacactatgagtcaggtgaggtggcaatcaacctgacaaaaggtaacggaccgggtgcgctggcgcacgaatggttccattctctggataattattttggtcgttatgacgtttccaatgacgggaaaattacgtcaggtggcgactttatgacggaagcacagcgtgtcaggcgcatatttaaagacggcaggtatgttgatgctgaatatccggtacgtcaggaggtttacgacgcttttaaaggtgtgattcaggccattaaaaacagtgacatgccgcgtcgttcagcgcttctcgataaggtgcgctcaaaaccgtactggtcaacggatgttgaaatggcggcacgtgcctttgagcgttatgttcaggataaggcgcgtatggctggcgtggagaatgattatctggtcaatatccgtaaggcacctgagcacaacacagataacacctacgcttatccgacgaatgcggaactggatggcggtattcgtgaggcattcgatcacctgttccgcaccctgaaaacccgtgagacggacaagggcgttgcgttttattcccgtaagggcgttacccgcacacctgaaggtaatctcatttcggatgttaaccgtagtgcggaagccaaaggcagcccggtcccgcaggttgaagcggttgcccgtggcgtgatgagcggcattaaggacagtgacctgaaggtccgtgtggtgaagtcacagaaagaggctgaagcgctggcgggtgaattgttcgatggttacggcagggtgcacgcattctatcgtccggataaacgagaaattgtcctggtggcggataacatccctgacgggcggaccgttcgcgagaagctgcgtcacgagatcattcaccatgccatggagcatgttgtcacaccagcggaatatcagacgattatcaaaaccgtgctgaaaacccgcgacagtgataacgtcaccatccgtgaagcctggcgtaaggttgatgcttcctatggtaaggaatcaccggaagtacaggcgggtgaatttctggcacatatggcggagaaacagccgaataaattcgtggcggcatgggagcgtgttgttgccctggtcaaaggggtactgcgtcgtacggggttactgaagccgacggaactgaacgatatcagacttgttcgcgagaccatccgtacgttaggccagcgtgtgcgggaaggttacacgccgcgtgaggatggcgcgggcgcatcgtttcagtactcccgtagtggtaaacgtgatccgttcaaagtgccggaaggtgagggcgagcgttatcgtgatgaccttgccagaatgatgaaatctctgcgcaccacagatttaacggtaaacatcgggcgtacgccgccggtattgcgtcaccttggtgcaccggatttgccgctggttatttcccgcgatactgtgcggaaggccaccaatggtgtgaaacatgtggtgccgatggatgttatcgagagactaccggaactgatgcacgatccggatgcaatttaccgctcagcgacagaaagaaatgcggttgtgatgctgcttgatgccgtggataaaaatggtgatccggtggtgtcagcggtacacatgaaggctgtccggtcgcgtctggaaatcaacaaggtagcttctgtttacggtacagaaaatggaaaaaaactgaagagtatggaaatgaccgggttaacgttgtaccggagagaaaaattaagccgcgataaccttctgcacagagggctccaattgcccaaaggggaacattcttatcgcggctctgcggataaaatactctatcctgaagatattcgcaaggggccgtattactcccgtaccagcagtctgacaccggaagagacaattgcatcgcgttttgtgcgccagatgcaggataaattccaggtgctgaaagctgttcaggagaatatccgtaaaactggcggcaaagtggacgacagtaacaacgcttatatggcggaagaactcttccacgggaaggcggaaaacgacctgaacgtgatgaaggagcgctacgttcagccactggctaaattactggcggactacaaaattgcgcaggccgatctggatgagtacctctacgcccgtcacgcgccggaacgtaacgcgcatatcgcgaaaatcaacccgaaaatgccggacggcggttcggggatgaccaacgcggaagcggcggaaatcatgcagcgtgtacgtaacagtggcaaacaggcacagtatgaccgtctggcagggattattgacgatatgctggcccgtcgccgtgagcttatccgtgaggccggacttgaagagaacggtgtggtggatgcctggcagaacgcctaccgttactacgttcccctgaaaggtcaggatgttgacggtgtggtgtcactgccccgtacaggtaagggcttcaccatcggcggacgtgaaagcaggcaggccatggggcgtgcatcccgggcacagtctccgtccactcaggcgatacaggacctgagcgaatcgctgatccgccatcgcaaaaacgaagtgggtaacgccttcctgaaactggtgcaggataatcccgacaaggattactggcaggtattcaccgatgacagaccggataccatgcggacgattgcagagcgcaaggaccaggaaactggtgaaaccattcgcgaagttgtcgaacgccctgtaccgatggcaatgatggcagaccggtacttcaccaccaaaaagaacggcaaaacgtactacatcaaactccatgatccgcgcctgatgcgtgcgatgaagagtatgggaccggaaaccagcaatgcctttgttcgtacgctggggaaagttaaccgcttcctggcaacggtgaacacgtcgtataacccggaattcctggtcagtaacttcatccgtgacgtgcagacggcggtgatgaacctgaaggcggagcagggaaggagcgacggtaaactgaaagggctggataacttatccgccctggctgtggtgaaagacagccgttctgccatgtcagccgtatacgccagtctgcgtggtaaaaccctcacgggaaaaggtgcacagtggcagaaggtgtggaaagagtttgttgaggacggagggaaaaccggctggtttaacatgggtgaccttgaaggccagcagaaggaaatggatcgccttgtctcactggcgaaggggggatggaaaggccagagtatcggtgcatggaattcgttccttaaccttgtcgaggatgccaacggtgcggttgaaaacgctctgcgtctttctgcctataagcacgcccgtgatgccggtttgtcacgccagcaggcggcgtctcttgccaaaaacatgacggtgaactttaaccgtcgtggtgagcagggggcgctgatgaattcgctgtacatgttcgccaacgccagcattcagggaacggcaaatctggtgagaacgctcggacatcttaatggtgagggacctttactggagcgccttcgctggaagaatctgaatgttccgcagaaaatcgcgcttgccgctgtgggagcaggttatctgcttggctcgcttaaccgcagcgtggcgggtgaggatgatgacggggttaactggtatgacaaggtgccgtctcatgtgaaagagcgtaacctcgtcattatgaaatcggtgttcgggggcaaggccggagagtactggagtattcctctgccttacgggtacaacgttttcttcctgctcgggcatactgctgaaggtgtggcggcgggtgacctgacggcgtcccgtgctgccggtaatgttgttggtggtgtgcttggtgcattcagcccgattggcagtgagacgtcggaaacactgtccggggcattgctgaaaaatgcagcgccgaccattctgcgtccgtttgcgaaccttgccatgaatgaaaacttcatgggggcgcagatttaccaggagaacatgccgtttggtacaccaaaacctgacagccagctgggaagacgttcaacgccagaagcgtacaaggcgtttgcatcctggctgaatgcgttctcaggtggcagccagtaccgtcccggcgcggtggatatcacaccggaatcgctgaaattctggattgactatatctccggagggacagggcgcttcatttccaaaaccacggatgcggcggtgaaatcgctgaatggtattgatataccggaacagcaggtgcccttcctggggaaaatttcgggggaggtgatgccgtatgcagaccagcagaagatgtacgaccggatgacagagattgcgcagtatcacgcagagctgaagagtctgaccggtgcagaaagaacggcgttcattgacgagaacaacggaaaattgtcgatgaacgggcttatgcaggatacccggaagagactgaaggatttgcgtaaacagcgtgatgccatttacgccgacagtactctcagtctggcgcaacagtcggcgatggtgaaatcggtagagcgggatatgaaaattgccgtggatcggtttaaccgcgagtacaacaaaaaagtgggagtggattaacagaaatggccccgtacggaagtgcggggctgattaagaaataaacactcattgacctgtaataaccggagctattaacatatagtcagaagagcatttcatgtgatacagagagccgatttatgtttaatgaagaaaaagttgcgcaaatggcagcgtatttgctgaaaaagcatggcggatctatgcgtttcattaagctgaagcagcaacggtaatggcgaatagcatttatgagcaaaataatcttgatatgttattaggcgatctgatgtaaccgggatgatgttcaccccttatcgccggggaacaataccggcaatcagaattgcggatggaactattcaggcccacgatgatatcgatgaggagttttttcagccagtattggatggctttcttatatccaaatatacgccatttgacatcctccacgccctgaaggacggggttttacagcgcaccggataagattcggtgttttgttgaaaaatactgtgataacaaacagaaaacccgtcagtaagacgggcttagcaagctgggacggttactttaataatttcagtgcctttacatccacttcaacactgctcaggtctttatcaatttcaccctcaattcttactttgtctttcggagaaacattctgaccggcccatatgctgtcatcgatatccgtgacaattgtcccgctattgtcacgaaactcataacgttcatcacccacttttttaacgatgctcccttcaaggataacccatgcatcatccttcagttcttttgcctgcgctactgttgaacgctctgcttcaggcccttggaaaccgccctgctgtgcaaaagcgccaaaagacacaccagaaataagtgctgcaatcaatacctttttcattcatagtcctctttcagagatgaacattcaaacagcattttcagtatggtaaagcgcgggtgcgttgaggatgcctgacacatcagaggtggcgggagattactcccccgcttggtctcttacttctcagattcgtagtctacgaagacagcgacctccgtctgaccggttcggattcgcacctcgcagaggtctttcctcgttaccagtgccgtcactatgacggttaaacagatgacgatcagggcgattaacatcgccttttgctgcttcatagcctgcttctccttgcctttcggcacgtaagaggctaacctacatgtgttcagcatggattgagcctcagattaatgttaagcgtcttgccggacgcgtaatgttaactggggcttttctctatctgccgttggtgttcatgcccgaggcagatagcctcaagcacccgcagcaattctacttaactctccttttcccgcaaaccgtttttatctccagcgacaaatcgaatacacaaccagcaccaccgccattactgttcctacatttgcgaatgcttcaggccaggtcattgattcaccttctgctcaatatttttaaggtcattttccgcatacagtattgcagttcttgctgcccgcaaccgtgctttggtgttcttttcttcacgctcgaggctggcaacagattctcggagctgatcgtgtctgttatgaagctgtctaatctctctcaccacagcctcaccatcgttcgcacaccgcagaacatactgaaaagggtccacaacacatccgcactgcaagcacaggataacgtgatcctgttcatgaacctcaatggcccgatgcttacagctctgttgtgtgtagttttttctgccagttactgtaatgttcagcagcttctcttcatcgcgctttggctgcaccagtgtgatgatattatcgccttcattttccatcagttcacctcctgcggcggttctggtagcggcatccagtgtgacggtttccacgacgcaccaggaattatccacccatcattagcgtcaggatgccccgggatgtaagtcgcccacttcattcgccagtcacctttcctgtcaaactccacggcaacaagaacggctgttttggtatccggcattcgctcactacaacttatccaaccatccggagttaccggagagttgccagacagcgcattctgcaaccgttccagcttaacgtattcctgaaccctgtttccgtcgcacgcctgaagccattgctcagccttttgcgcatcagtgtgaaaggcacaagtgcgaccgtcatcaaattgcatttcgtagaggttagcaatctgttcaaactgcgtgtgtggcaacttgtaagtttggcttacgagttcggcttccagttctgctatgcgcttctctgatgcttcaagtaacgcctgcttatcgcgtagcgcttcttccagttcagcaacatggcattcactatcaataaggttgttctgtgctgctcccagctccactctcagcttcccaaccgtaagcgcaatctcctcgttctcctggtcgcggcgtttgatgtattgctggtttctttcctgttcatccagcagtgccagcacggtagccgggttagcctctgctatgaattcagcgtttgcataagcctgatcatctgattcaatcaggcagttaacatgacattccgcaatcacgccaccgggttctcctttccatttttggcaaacaaaaactcctgttaaattgccgtgctggttaacagatgtatgccctacgatgtagcttcctttagttgctttctctgccttttcacgcagtgcctgataattaatttcgctcacttcgaacctctctgtttactgataagctccagatcctcctggcaacttgcacaagtccgacaaccctgaacggccaggcgtcttcgctcatctatgggatcgccacactcgcaacaatgagtagcagatggggcattactatcggatttgtatttttgcagggagagattgcgctgcaattcttcgatttcagcggcgttgtcgatgatatctgccattttcctttccttcaggcatgaaaaaaggagccgaagctcctttggttttagaattcgaattgccttgcccgcaggcttttcagcattggtctggcccgctgaactacgaaactcgactggtcaagccgtgccgcctctctcagtagcacatctctgttcttcgtcaccatgtagatggtctcaaacgcaatgtcatacagcttgttcgtgtatgaggagttcagctctttcatgatcggatacaggtgtttgctgaggtcctgggctttttccatccagagttgcatgtagcagaggaggatgatttcctcgtctgtgaattgttgctgtggttctgcttgtgccgactgcatgttgcgaagtttcttttcgcactcgatgaagtatctgcgtatctgtcggcctttttcgttacgctctaccatcgccgtttctttggctgtatcgagggtaaggtggtagtcttttttccctcgcccataacctatttcccgtttctgggaaatagctatatagtcctgattttcaacgaatccgtactcttcaatacgttctgtaatccacgatgcaaagcgtttacctactccaagaaaagtatgtaaatcacgggcattaacgagaagagtggtttcgttggcgatagtgccgttgaatacggggatgcgttgactggtcatgatgacctccttatttgtttagtttataaccgccagttagtagctggcggtcgggtgtcaactgagccaaataagaagctctgggcatattccccttgcgggtgttgtattacgcctctccacccgacctttgtacggatgtaactatgccaaattgcaggcataaaaaagccgcaaagctatcgggtgcggagaccgcttatttgttcagtgcggtcagtatgcgatagctctggaggatttgtcaatcagcggaatattgatgaacgggtaacggtaaatgcctcatccagaaaattaacgcaaattcgcatcgcaaacttgcgttaattatctgaaatatcaagttaaatccccttaaatgtttggggcactattggggcaaaatgtggttgtttggggcactattggggcaaaatgtggttgtttggggcatatttggggcaaaaaagaacgtataaagaacggtgtaaaattgatttcttcatggtcaaaatgaggtgtaacagattgaaaaatatatgctcttggacgatcttcggtaattctgtgtttttaatgcttcatg

SEQ ID NO: 63 - DNA  (genomic), 2499 bp; double-stranded, linear
ctgaagagtaattagttatcttttgctttttaacccgaatgttccctgccatgcggtataagttgcctggcagggagtgttcgggggcaattgctatttgcccacccggcacagatgaacaaaattgccgctatcggtaccttcagcttatgtcctgcggctggttggttgggcgagatagaatggattcgacatattcccgctgttttttaaccacgccagttttctcgcaccttgcttggtcactccgctcgatttcaggtaggatctggcagtagaccactggaagccgcgttttttactccacttttcggctccccctgcgctgttacgctcctcctgggtcatattcgcccattgtacgatgtctccgaaggtgaacgtgacccatttctgcggccctgtcagcttcaactcacccagggcggtaagcccgtcgttcttcaggtaattcctggcagtagttggcgcgaggtttctttccttacaccacttttctaaataaccaaccggttttcgcacatgcttgtttaaggctgcccactggcggatatgttcaagggtgaatttggcatattcatgcggcctgtttacctttacctgtcccgcgtagttcaggccgtgatcggtcaggtaatttctggcatttttgatattaaaatgattgcgcgtacaccatcctgaaactccctgtagagcgtttcgcgcctgctggtccatagccgcccattttcgcatgtcgtctacagtcaatttaacatattgctgtggctcgtccgcctctggctggtcctcgatggtctgcctggtgttgtttatgtcgtcatttgcagcatttggtgggatgttgcttgtattacacgattgctgtaattccacatcgttacgccacgccagcggagacatatttccaaattctcgcatgccattgttggtaaagtgtgtttcttctcttccgtattgctgggccggggagtagcgagctgcttcatgcaccctgttttgactttcatccgtgagtattggccgtacggaccagagatcaaaggttccatattgactgcgtgacatcagggttgtgacaatggagtgaaacagctcaagagtaatatttgtactggtgcacacaccgctcttgctgactgcaattttcatgagattgcccgtgttgtcatgctcttgcgtcttcgtgaaggtgatggtgaaaccggcaacatcgaaggtgaacggttcaggaagttgcagatcatttgcacttaccaccggttggaactgatgtcgatgcagttcggttgtcatcgcagcagccagcaagtgaacctcttcaggaaccagtggagctacagccatgcccgtgctgtagtccgcatcccttttgatataattattcatctgcaccagaagcgtcaaagtttccagacaactactcgggagttgttgcggtggaatataggttgctgcgctcgtattgaggttggatattggtctcatgtaatgctctccgtatccttacagggttaatgattcgtattaagtcgtagccatccgcatggctccgggcgattcagtcggcgcaccaggatgtacacttcggatgcgttcttgatgtagtaaacaatccgctcattctggtgttaatggaaacacccgtaaaaagcaggaggaatgccagttattggcgaatttacaatgctgccatcggggtgagtttcatgaagattattatttttttttacgccttttatcatcgcgttaaataataatttcttcctgtgtttcataaagtatatagttacaattactcgtgaattttatcgataactcgacgttagccttcagccagagaaaaattaactcgcaaattttttaatttatcgttaggggaatgggtaaattatattctcgaccctaattacagggttcatctgaaagcagtggcgtctcatcttattacttctctttctgtattcatgctagtgggtttgtgataatgtcatagtagaaaaatcgtgagaaaaaagccctgaacaattattaaattattgatttttgtgtgttggtgtttttggtgattgattttcacgatgatctattacttctggttaagatttctatttttattatgtgtgactttattaatgcgcatcctgcttcgttttatcgtgatttagaattgtatgtagcattagccataaaatgatatcactgggaatataataaggggaattataattttgggggataattaggcactatcaaaaatcgctcattccagacttaaatacacgttttctcctgtttaggttgtgggcaaaaaattcgatgaggagatgaggtataatttcattcacaaccttatcactatctattaataagcaaaaaacaacgttcttttgtgaaacgactaactgaaaattcaacccttcgggcacgctgcagcgagtttgtcgccaccaacattcgtacaagcttcatctgccgggcgaaacgtcagctaaa

SEQ ID NO: 64 - DNA  (genomic), 31728 bp; double-stranded, linear
agcgggtgattttggtaagcgctaaatagctattcgcagacatgcgtaacaattttcagaaatatcatagtactatatgatcttaaatgcttatcattgatcagtctgctatcacccgcttttactggcaattgtactataatttcttaggttgcatcaccctgatgcgtggggaaacatgtatggtattcaacaaaaaaatgtttgtactcattataataccaggcattctgggggtgttactgtcgtttgctatgtcagtatttcaaatgaatcgagatacgacaattaccgccggtattctgttaaaacagcttgataatgttacgcaaattgtcaaacatacgacaaagcttacttctattctggtgatgaaaccctgcaaagatatcctggaacaattgattgctaacggagcattgaccccctatgttcgaacaacgggtcttatagaaaataatttccaaatatgttcttcagttagcggtttcaaaaaaatgaatgttaacgatgtttacggtacgagctttcacaataaaaataaagaatcacgcatagtatcaattagcggtacaagttttgtaccaggtaaaacagccatagtgttccttatgccaatagggaatgatatgacagcttttagtattgtagagtcacgatatatctatgatctgatggatgttcttgatgatgagaatgatgattcattttctcttcgctttactgaagggcctgcaattattagtggtgtaaataataatgacaggttatatatgttaaaaaaagattttaattctgcgatcagtcaggctagtcttacagttactacgccgatgatttcattatatccctatgtcattagtaatgtattttacattcttccattatctattcttctttcttttatcctgtacttcttatggcagcgctggatatctcggaaaatgtccctggcagaagaaattaagaaaggaatgtcatccggagaattttctgtgcattatcaaccagtatgtgacacgacaaccaaagcgtgtctgggggttgaggcgttaatgcgttggcaacgcgaagatggtaaaaatatatctccggtagtttttatccgcgctgcagaagaggaaaatttaattataccgttaactaagcatctctttgaactgattattcaggatgtacaaagctggaaagtgaaaaagccgtttcaccttgggataaatattgccgctgaacatcttgcacatcctgattttgttgctgatgttttacatataaaaaatgcaatatctgataaatttaacattgtccttgagattaccgaacgcaatctggttgaagatactgatcatgcattacagaaaataaatgaattaaggagccatggctgtgaatttgcagttgatgattttggcacgggatattgttcccttggccttctgcaaaagttgtctgttgattatcttaaaatagataaaagctttatagacacgctcactacagcggaagacgaaacgcctgttttagatattattattaagctgagtaatcgactcaatttgataacgattgcagaaggtgtcagtacctctcaccaggcggaatatcttattcataataacgtgacattagttcagggatacttatatgcaaaaccaatgaaagcgacagagttttatcaatggtatgtaaacagataaataattaaccaatattggaatggttttttattgccttaaaatataaacaaagccatcagaaggttattaactggtgacaaacgccaggagcaacaatgctgttagtgggaaatacatatgaagcgtggtgtcctgcctgtagagaatacggtagttgtaatcattttgacgtgtaacataaaaattaattgaggtgtcaacttttatgaaaaaatcagaagtgatattttcaaggatttcatcactaatgttatcatctttttgtattttttgtattttaacagtggtgaagtaaacggtatcacggaatttcttgtatgtaaaactcacatatcggcggatgaagcctatcttttttccatctaccgtgtatgcgcccgtgagatacatgtttcctgtgttattttcagaaatcatatttaacgaaaaatattgatccatttttgtatgatcggtgaaattaataacatgggcattacatgatatgttttgctctgctggttcattggcatgatgaaacgcaatatggctcagaattgctgcaataaaagcacataaaattattcccgcaaacagaaaatatctttgagtcatatgattactccgctttataatagagagagttgcaattatttggtgattcagagtttaacatctgactacaggtgaaagcataaaatccgctcatgctatcatttgttgcaatgtaaatgtaaggatgtattttgcagttaatttccatcttctgcaatttttcaataatcggtgataacatgtctacggaattaaagtatttattatcatagaaataactgcatccttcctgagtagggtgttgagcataatttgagaaagcatctattttttttatagtgtgggatttgctttgaaaagccatatcgaaaaaataagaagatatatacactatcccccatgccgcaaaaaaacaaactataagtaatgtattctttgtggtaaatataccttttgcaatgtgatttttatttatattttcagtgtgggtaccattctcttcactctcaacactttcattctcattgtgattattgtcgagaacagttatgctgatttcttcattgattttgaagcctttacggggcaccgttctgataacatcattaaatatcgtcgctgagctgatttcacgaaaagaacgtcttatcatcgatatattttgatataaagtgttggttgcgacatcggcactgctatcgctccagactttttcaaagaattgattgtgtgacacgacactataagcgttatctaaaagtaactttaagcattttcccgcaggataagtgagtatcacttcctctgatgtaaggagtgatgttaacttattagatgatgagttgaatcttacttcatcatttataatgtagatcattacattttataccttagttgtgtattacaaatccagtattactcagaaaataaaggcaagaacattaagtgcactatagtataatttcctaaaaatgcaaatctgaattatctgatttttaagaataatcttgatttaattgaaattcttaaacgatgtatatttctattaaatgctttctgcagtgatgtgaattaggggtttttctgcatgtactgataaaaactgcgtatccccgttatagggaaagaacgggacgcatcctccacccatgacactaaccgtgtgattggtagttccctgctgtgcacttctggtgaaatagaagaagctctatgtgccgaccggtactgtcttttatccgattatttaccagtgacaccttgatatgaggttatatctattattgctaggaggtaatatatgcttatgttattatccaaagcgccaatagtaatttagataaagattatagatcagcaagcaaatccagtctgtttttttgtgcgtactgcataacatctatgatgactatatttttacgtgatacatcactacttaaatgtatataagatttgatgtttattattcatgctgagttttaatgtttatatttttttattgaaatctaaaaattacttaaattatcccttaaatattacttactcataaggagcaatgtgtgatatgagcttttctattgaagatttttcattggattttttttcattacataacaaggtggccatcgtaactggggccgcgggtgagctggggagaggcttatgctcggctctggccaaagcaggggctaatctattgttggttgacatcaaagagcctgataatagatatttgaagcatttaactcatgaaggcgttgaagttgagtttatgacaatagacataacaaaacctgatgcatcatgcaccattattaataggtgtctggagcgtttcggtcagttagatattctggtcaataacgcgggcgtgtgtaacattaatcgtcctatcgatttcaatcgaaacgactgggatccgatgattaatctcaacctgaatgctgcattcgatatgagccaggccgcattgaatatatttgtcccgcaaagaaaagggaaaattattaatatgtgttccgtattgtcatttcatgggggacgttggtcgccagggtatgcggcgactaaacatgctttagcggggctgaccaaagcgtatgccgatgattttgcggaatataatattcagattaatggtatcgccccaggatattatgtgagtgaaatgaccgctattatttataataaccctaaaataaaagagttaataaaagggcgtataccggctcaacgctggggaagggcacaggatcttatgggcgcaatggtgttcctcgccagtgccgcttcagattatgtcaatggacaactattagtcattgatggtggatattcaattcgttaacgatttttggctgcgttgaggtgttttgactggaaaatggagtggagagattttgtcatttctccacttccggtacttcaggtgggtatagtggttattcgttagcgttgaaccatcgcgatgagtttacataccactcagagcattattgcgctaattgttgttttatctgtgcaccattatcatcgagatatgtcgccgcaaccacaccactaacgttattacttgctaaccagtaccgtcgttgactgaagggttttatcatcatatcgctttcttgctgcacctttgtagccccaatgctgatggaggtgaaagagatattcagtggtgttgggttattaagctcaatatagctactgctgccgtcgttacccagatgccaacttattttacgcatagcttcttggggcgtcatagttacagattttggcctgtaaaagattttaagttgcgtattcattgccagcgttaaatgtgtgggatcttgatggggagtttctggcggcatttcataaagatttaaccagaatgcagattcgcgatcctggggaagtgggtcatgattatagataatccgcaacccctgggttcgtctcgcagccaggcggaaaaccggtggcagcaccacaaaggggggagaagcagcttctggggaaccttcaccattatctacccaactttgcaccagtaccggatagtcattggtattgaccagcatcagtgtcttttcccgatcgccatcgcgataaataatccgtgaagaagccggcatgatgccggcttccactgactgtacgaacaagatggttaagagcagcaaaacggatttcattgcattttcaccaatatataagccgttgcccgcacttttcccgcactgactgtctgatttggcagtttcttcaaccgggcgataaaagagtaactatagctggagtatccggggtgagtcgcaccttctaatgttgccccttcaaatacaggataccaccccgctgcatttcctccgggggttaacttcgcgatgcccggttgaccaaccagcgtcatcgccgtatcggggtgagcactgttagaaatgtagatcccaacgccctttgccatctctgctgcgtcataattatcagagaccagggcgctgacgccgccgttgctattgataatccccagtttttgcgccgctgtatatgcaccttcagacacctggattcctaatgctgtctgagtatcgctaatccctgattgaaccgagttactacactcgacgcggacattaaaattaccggtactttccatgcccgcattcagttgtgcttctgcaattgtcggcagcaatactaacggcgtggcgctgcgggcaacgcaggtggcattgttgtagagtcgattggccgaacgcattccgtaaccaaaaccattatcagcaccccagaaatcccaatgaacagaactatcttcgccgggctcatcatgaccaaataaaatgccgctggtaccggaaagctgaatataggcattgggctgaacacagttatagattgtaccggaaggttttgcgaatccgactccactactatctgtattattattaccgcaccaacttgttgttgctgatgtatcaggtagcgtactgatgcgataaagctcagcatgaagaggagggatatcctgtaagcgaatctggattttagttccctgagtggcataactggtgatgggcactttcttccagtaacgaccaagcgtcacgcccgccatggtctgcttgagaccgacaaaagcgaaccaggtggcatagacatcactcagaccatcaggcccgcctgcatcgtaaaagccccccacgcggtcgtcgccattggtagcgaccagaaaatagatgtttggcaaatctgttgcatcacattcccacaatacggagcttcctgtcgcgccacctgatgtgtagttagtgggaggtacgaccgttgtcgcgaggagtgaacctgctggcgcaaaataggtgtcggtcatattaatttttccgaactcaataagcgctgtccgaccatcttcagtttgacctatctgtgtgtttgtacagttagcccaagcggatgattgtattagtgccaccaatatgatggagctaatcagaatgtgtaaaaaagtcgatttagacatcgggttttctctgtatcaagactgacaggtttcattcaggcggatgatagggctattgctgtccttcccgctgatatcaaagggcaattggcagctatcgttagcaccttcaccccagcgaactgacaagtggccttttgtctgttctgtgcggaggtaaatttgccccccctgaccggctataccgacgactgtattattctcatccagcacatcggctcccattggcagttccgaaccatctgccatgcgggatttaatcagcaacgctttaccaggacgggtacggaaaattactttcaccgccgcacccgcaaccggtgctacctgtctttcactgtcgaccaactcggcatcgccatccattccttgtggatcgagagatatacggttgtagcgatagggcgttactgccggaacaagcgcatagccactgtcattaatttccagctgactggagttatagacttttgcaccttctgcgcctttagcttcgaccagggcgaacgtttcacccagataaggtccgaaagtaatgccgccaccatgcacagccatcgcgccttgtacgttacctgaagcctgccagtaatcctggcccttcgatgcgttcaatccgacggtagtttgtgaaaaacgtttttgcatgtttccgctaagcgtcgtctgcttatattgttgatcgcgcatgacgttcaggctgtagttggtggtctgtgcttcatcaagcattccggttagcgagctttgtaattgcgagctaccgtcagttgaatgggtccagctgttgctaagacttggtacacgaggtccattgccgccaagtgggaatgagaatgaaagggatgttaccgtctgcatatcatcagaattgtctttatagccgcccattctttggcgtccgacggaaaggttcatactgatgccatggctaaagctattgctgtaacctaactgaagctgtgtatcacggctcttgccgccacggtagttctgtgttgaacctgacacaaacaggttgccgtaattcgcaaggctctgacttaacgtaagatcgaagcgcgactgttgacgccactggctggagtcccatgactgtttattgctggcagcatgacgctctcccagcacatcagccagatcacgatagccgctggtagagtatcgataacctgccagggagacggtggttgaagtaggctggaaagttttactccaggttaattgcgacatccaaccactctgcgcttcgctttcgggaacacgcgcatgggaccaagtgaggtttgccccaaatgcccccagcgaactgccatagactccgcccagcatcagcgcctggtagccatcagcgatacgcgaaccactgttaaatgtcagcgtattagtcatcccgtgctgccaggtaaggtcaccaaacatcgagtcatcaccactatcctgcgttttacctacttccacgttataacgggaagttcctggacgcatcgattctggtacggctgaaaaggggacactgaaacgactgactgcgccgttagcttccgtaacggtgacatccagatcgccgctgtagctggtggggtataggtcgtttatctcgaaagggccaggagccacggtggtctgatatatttcatgaccgttttgcattaccgagactctggcgtttgttgcggccacgccgcgaatagtcggcgcatagccgcgcatggagtccggcagcatacgttcatcggtcgcgagactaacgccgtgataactgagtccagagaaaaatcttccgctggtgataagctgccccatcattaactggctatttatggcgggcagcgggcgttgcaaatagctacgaatattgttccactgattccctttgtcattatcccaggtcatgttggataactgacgatattgccaggcaccaaggttgatgccaccattaaatgatgcccatagcgaacgctggctatgagcattctgccctgaataggcaacgttgtaatagttggcaatataattcatgaacgccagcgatgctccggtatccagctcgctggggggaacatagccgcgagggcgactaatcaattgactctgtggcaccgataagtccaggcgcaattgtgacaactgtgtctggctggtgatgccgggagcgagttccttagcaaacgtacagacaggatctttttcccccttatcttcccctgttttgaggcctatcgcgtccgcgacttcaggcgtcaggcagggcagaacgcgaccatcagcggcttctttaaacgtgacattccaactgcctgacaacttattgttggtgtagatatccattttataattgcccggtgcaacagactcacgtgttgtcagttttgctaatgacgactgactaaatctgctgccgcggaagagttgcgggtcaaaggtgtagttgtcttcatctgacggtgttgcgggtgagatttcgctccccatgaccggttggcaaagtaaaaccaacattgccgcagaaattgacacaacggatttattcatctcgacgtactcgtgcgtgaaaaaggataccgctcaaaaaaggagaaagaggttataaggcatgctcagacgtaacatttacgccatagtcgttgacggtcactaaatggatctgcgcaccgggagcgacactgatgccagagggtagtgtccattcagttgtgctttgaggagcaatcattaccgaattcgcgagggggacttttttaccattattaagcagttcagcggcgcgaattgtgacgtaatagcccgtgggattcgtcacttcaatgcggttctgttttacctggtaagtcaggtttttgggtgcgtcactggatttaccgacaatcgagctgggacgatagaaaattttgactcgattagtcagggccaggatgagctggttctgacttttatcattcttattcagataaggtagttgactgaaactaaaccagaaaacagactcgcgatcctgcggtaaattattaccagtgtagagcaggcgtaacgcctgacctgcggcagcttccatgcgaaatgtctgcggggttggcataaacggtacattcttgtcagaaccacgttcatcctcaacatggatattaatgatatagggctgatcgctggtatttcgcaactggatggttttttcctttgcgtcaccagggaaaataatacgggttccggtcattaccacgctggcaaacgcgctgctgctcatgctcatggaaaatacaagtaccagtaaatatgcaaaaatgttcattcttatcttttccatgtccatgaaaaatcactattaattgtgcgaagaaatactggctggcatttactgccagccagtagattaattagaggtagctcagggtgtattctgcgacagcggtaattttaccggcagtggcagcagcgctatcgataacgaagtaacgcgcaccgaagtcgtagctggcttcggtatcgccaactttcagggtcagacccggtacgttagtcgcgccagccagagttactgggttaccagaagtgctggaatccattaactgaatgccaaagcctttcgccgcatcgctgctggtatcacggtttcccataacacccgtgctagcgtcaacgtcgtagcccaggaaggtggtgttgattgcctgatctgcaccagttggagcctggcagttagacacagaaaccgtaaacggcgtctggcctgcgctctgaccatcagctaaagttgcaccgaagtcagccatggctacggtcggcatcaatactactgaattggtttgaccgttgatatttacggaacaggtctgatcggttacttcaccctgaaaagtgactgtaggcgcagccatagttgaaaaaggtaatgcaatagctgccagcagagctgcttttttgaaagtagaaaacatattaatatccttgaaatttagagttaatatagaacgagttaattaatgcaattgatacaatctgacgtttttaaaaccggtaaatctccttaactgtataagtgccttgaaaatgtaaaagccatcactatcacaagcaatttcaaacttgttaaaaactgatattttatagtgactaatatacttgacatccttttttagcagggtgtgcaatattcttttgttatctatcttaaaatataagtaatagatatcccactcataccttgtcagagtcacctgcctgacttgctggtctttatcagtacttttaatcaaagtaatgagtttattcaattttatatatcggctaatgaatgtttgctctgaaagtgaaaagaagatatttctgtttttcatctttcttagtgaaacaatcattaaaaacctggccaaatctggcagttttgcaagtatacttacgtcatccactgcgacaagaagtacgttttttgtaaagcggttgtcaaatctaagtgtacttaggtcattattgcatgcattttgagaacaaaaaaaacactcaataaaaaaacgataatggtgacctagttttgcacttaatccctgaaggtaatatagatcatccgaaatgataattacccttgttagtaagttcttgttcattgcactaactcaattgcttgcagcaaaacagcccatcttcatggagtaaaaattttgaaagtgaataaagctttttactaaagatgtaacaatgggcattccatatgcgacataacaactgcagtaacacaactaatctttgcgtgttctttatattagagagtaacagcgtgatatctgtatctctaaaagaatagcgatgtcctgcaatcgatgagcacaatatatgacattcatcacatgtataacaattgaattttcattcatactaatgttgaacggtaatatagtaatttaatgcttgccgaaagatgataaacagagttttattctgaataagagtgttttttgcgattttctcaggttgtaaattctgcataatggctgaacctattactttttatgtcaaaaaagccgtttttataagaataaaacaacgatatttaagagtgctggcagcggagaaaagggttaatacagtcatttaagattacttcagcttttcctgtggtgagaaatgagcggaattgtagcgcaatctgtaaaaacaattcctcttaactaataaaaatcgcgaataatcattgtgttagattgatttgttgcaaaataataacaacattattaaaatcattacaatctttaatttagaataacatttttatgaagaccagaatacgttaagggatgatgtatagcggtgattgctattagatgggaatgaaagcttgccaaaccgttttgctcttctttctccctttcaacgataagccaggcataatgtggctgcttaagccaattgtcgcaaagccaaagctctctatatagctaacctcatggttaatccgatctcagtaataccatgagcaagaactctttcctttttatataactcttaagggttacatgcgtgaatgcaaatggtaatataatgaaatgtcgcctgcccgtaatgaccataaagaatctaccccgacgtaaaagatatagagaataagatgcagtaatgatgatgctttgttaatcaaataataagatttaaattaattgtaactcaccaactttgttgttttattcggatgtctgaaatgatgtcgtacagaaaactacatatcatttcagacgtcctctaaattggatttttttcacccaaggagcaaggatgggggacttttaaattattgtgttttagtaagttaggttcttcgccgttcgatgaaaaaacaataactcttagttgtttttttgagtccttatttcagcttatttttcgtgattttttattgcgccaggtgataggatttgccgcaatcatttttgctgatattccgtgagtcatcaaaagtgatctgcatgtccaaaatgaatagcatcaataaggaaaacgttagtggcgatgataaatttaagtaaggaagcaacggtggggaaagcattaacccctattgctatacttatgatgttgtcttttcctgtagcttctcaagcggcgggattagtcataaaaaatggaacggtatataacgccaatggtgtgccagtcgttgacatcaacaaacctaacggtagcggtttatctcataatatctgggataacctaaacgttgataaaaatggtgtcgttttcaataatagcgctaatgaatccagtacttcacttgccggaaatattcagggaaacagtaatctgacctccgggtcggcgaaggtgatcctgaatgaggttacttccaaaaatccttcaaccattaatgggatgatggaagttgcaggggataaagcggatctgattattgccaacccgaatggtattactgtaaacggtggcggttcaatcaatacaggtaaacttaccttaaccaccgggacgccggatatccaggatgacaagctggccggttactccgtgaacggcggtaccattacgctcggtaaactggataacgccagcccgacagaaattctgtcccgtaacgtggtagttaacggcaaagtgtctgccgatgagctgaacgttgttgctggcaataactatgttaatgccgcaggccaggtgaccggtagcgtatccgccacggggtcccgtaacggttacagcgtagatgttgccaaactgggcggaatgtatgcgaacaaaatcagtctggtcagcaccgagaaaggtgtgggggttcgcaacctcggcgttattgctgggggtgttaatggtgtcagcatcgattccaaaggtaacctgttaaacagtaacgcccagattcagtctgcaagcacgatcaacctgacaacaaatggtactctggataacaccaccggtacggtgacatctgtaggcactatctcgcttaataccaacaagaatactatcgtgaatacccgtgcgggtaacatctctacgatgggcgatatctacgttaacagcggtacgattgacaatactaacggcaagcttgcggctgcaggaatgctggcggttgataccaataacgccacgctgattaactctggtaaagggagttctgtcgggattgaagcggggctcgtggcgctgaaaaccggaacgctcaacaacagcaatggtcagattcgcggtggctatgtgggtcttgaatccgctgcgctgaataacaacaacggtgatatccagaccaccggcgatatcgccattatcagtaacggtaatgtggataacaacaaaggtctgatccgttcgtccaccgggcatatcgttattggcgcggcaggtagcgtaaataatggttcaaccaaaaccgccgataccggcagttctgactctctgggcattattgcagataccggcgtagaaattggtgcgaacaacatcaataacaacggcggacagattgcgtctaatggcaacgtctccctgtcaagttacagcacgatcgacgactatgcgggcaaaattctgtccaacagcaaagtgattatcaagggaagctctctgcgtaacgataccggggggatcagcggtaagcagggtattgaagtcgccgttggcggcagcctgaccaataatattggcgtgatcagctctgaagagggtgatatctccctgttagccaactccgtggataaccacggcggcttcatgatggggcagaacatcacgatggagtcgatgtctggcgtcaataacaacacagcgctgatcgtggccagcaaaaaactgaagataaatgcgcgcggcagtatcgaaaaccgcgatggcaataacttcggtaatgcttatggtctgtacttcggcatgcctcagcaaacgggtggaatggtcggcaaggaaggcatcgagctttccgggcagaacatctataacaacaacagccgtcttatcgctgaggatggtcctctgactctgcaggcgcagaacacgttcgacaacacgcgtgctctggtcaccagcggggcggatgcatctattcaggttggcggaacgtattacaacaactacgctaccacctggagtgcgggcaacctggatatcgacgcgaccacgctgcaaaacagcagcagcggtacgatgatcgataacaatgcgaccgggttcatagcatctgataaaaacctgtcactggaagtggtgaatagccttaccaactacggctggatcagcggtaaaggcgatgttgatgtcacggtgaataacggcaacctgtataaccgcaataccattgcggctgaaaaggggctggatattgccgcgttgaacggtattgaaaactggaaggatatttctgctggcggcgacctgacgatgaacaccaatcgccatgtgaccaacaactccaacagcaatatggtggggcagaatattgttattaacgcggttaacgatatcaacaaccgtggcaacattgtcagtgacgctgacctgaacgtgacgaccaaaggcaacctgtataactatctctatatggtagggtatggggatatcgcattgtcggcaaatagcgtggcgaacaataacgcgaccatcgaagcgacaggcgatctgattatcgattcgaagggtaacgtgggtaacaaccgcggtaatctgcatgcgttgaacggcgtgttgtctgttaaaggcaacaatctgaacaacgataacggtgaaattcgtggttatggcgatgtcacgctggcactgacgggcaactacgacagctataagggttcgctgacctctgaaacgggcgacgtgactctgacggcgaacattgtagacaacgcctatggtttgattgccggtgagaatgtttctgtcgatgctaaatcgacgatttacaacaacactgcgctgatcgcggcgaataaaaagctggttattaacgctggcggcaacctcgaaaaccgcgacgggaataacttcctgcgtaataacggcgcgctgtttggaattaccgacaacgttggcggcatcgtaggtaaagaaggtgtcacgctttctgctcagaacgtctacaacaataacagcagcatcatcgctgaaaatggtccgcttaatctgctgtccaggggaacgctggataatacccgcgcgcttcttagcagtggggctgatgccatcatccgtgcggcagggacgttctacaacaactatgccaccacgtacagcgccggtaatctcgacgtttatgcggcgtcgttgaacaacgccagcgatggtcgcctggaagacaataccgccacgggcgtgattgcgtctgacaaaaacctggatctgagcgttgataacagtgtcactaactatggttggatcagcggtaaaggagatgtgcatttcaatgttctgaaaggcacgctgtataaccgtaatgccatcgcggcggacaacgcgctgaccattaatgccctgaacggtgttgagaactttaaagacattgtggcgggtactgcgctgactattgatacgcagaagtatgttaccaacaacagcaacagtaatatgttgggacaaaccatcgcgatcaatgccgtgaatgacattaataaccgtggaaatattgtgggtgattattctctgggtgttaaaaccaccggtaatatttataactacctcaatatgctgagttatggtgtcgctggcgtatcggcaaataaggttacgaatagcggtaaagacgctgttctcggtggcttctacggtttagcgttagaagcaaacgaaactgataacaccggtactattgtcggcatgtaagatgtaaccaaagacagcagtggcttttaatattaatgcgtcatgtcacgcaggggttgctgctgtctttatttagtttgagaagataatgcaattacgatttaattttggtttgctgctcattctttgttgttttcaggttgcagcgaaagacagtcttgataatttgatcaagcagcaaaaaaatgcagatgaaagcacgttgcgcgcgcataaattagaaaaaaaagatgtttactcaaatgcacaacgtaatgcgtttactctgggtgatctgccgcaggaaaagaattgctttatcattaatcggattgaactggaagataactttctgggtggtcagttgatttctgaagtgcaaaaagcgattgccggacgttgtgtcggtagtgctggtgtgcaaaaaattgcagctgccttgcaggattattatattaatgcgggatatatcacaacgcgaattagtatcccttcgcaggatatttctaaaggcaagctacgtttccaggttaatgccgggaagatagaaaaaacgattgtcgaaggtaatgatatcagtgaatggatgttaccttttcagcgtaacgatattctcaatattcgtgatattgaacaggggctggaaaatcttcagcgagtacctgacgttgatgtgaaaattaatattgaaccgggaacacgggatggttacagcatcgttcatattgatacacaccgggggaaaaactggagcgttcgggcaagttacaacaattggggcgatgaagaaacgggccgttaccagacaacctcggtgggttatctgtttaatccagcgaaaatgggggatctgttttatctcgccggtacgcgtagtactaccggacagtatgaaaacgtcagtagttattattccattccggtggggtactgggagtacggctttttctatagcaaaagtaaatcgcagcaggtgattccgctttcgtacatctcgctggattatgttggcatcagcgaatacttgagcgcaaaagcgacgcataccgtttatcgcgataaaacaaaaaagttcgccggtagtgcagaactcattcgacgaaagtcgaattacacgcttaatggtgaggagctgacattacaggcgcgggatatgggaaatatcaagctggggctaaattataagcaacagttacccggcgcgttctgggattcaaccctctcgtggcaacgctttttaacctggttcggtggtgaaaaaacgccggatatgcaatatggcgacgttagcccggtaagcaatatctttaattttgagggtaactatacccgacaaatagagaatggatattacaataccgctttttttgcccagtacgcaccgcgtgaactgactttgcaagataaaattacagttggcgatcgttggagtattcgcgggtttgaaaatagcgtaggtttgtcagggaatgatggtttttatataaaaaatacgctggcatttcctttgcctggaatgaaagctaattattatgccggtcttgattttgggcaagtgtatcaggacgcttcttatggcgatgaatcactggtgggctcggcagttggtattgatggaaacattaaaagtcttgagtataacttttccgtttctaccccattaaagtatccggcgacattagatattgatcgggtgaatgtaaattttaatttttcgtaccaaatgtaaaggataacgagactcatgagaatagggacagatattgttgaaattgccagaataaccaaagccattattaatggagagatggctttttatgagcgtgtttatacttctcatgagcgcttactcattaaccctgcagaacctgattatgaacgggcctctggattctgggcggcgaaagaagcgttagttaaagcgattggttgtggttttcgtgatggcgtacgtttccaggatattgaaataaagcatgatgcagccaaagcaccttatttcgttatttccggaagactacaagaaatttttatcgggcaggggttgcaaaataactccctgagtatttcgcattgccgtacccacgccattgcgactgtcatcgtttattaactcaacatatgtgatgaatatgtacaaatataatgatttaaatgaaaaaaccgtactggtgacaggagccagtggtgatattggactgggtatttgcgaaaaatatctggagcagaactgcgatgtttatgcgctctataaatccaacgacgtgcaattaacggcgctgaaagcaagccatcctgcaggcgataaactgcatattgtgcagtgcgatcttgcctgcccccagagcgtgagcgcattgtgcgaacagatagagcgccaagctggcaagattgatgtgctggtaaataacgcgggcatcgttaaagacagcctgtttgcctcgatgagttatgaggatttcacccaggttatcgaaaccaacatgttcagcattttccgtctgacgaaagacgcgctgatgctgcttcgtgcggcagaaaatcccgccattattaacgttgcctctattgcagcgctgatcccaagcgtcggtcaggcgaattacagcgcgtcaaaaggggcgatcctaggcttcacccgcacgctggcagcagaaatggcaccctggggcgtgcgcgtcaacgcggtcgcaccgggaatgattgaatcgaaaatggtgaaaaaagtatcccgcgcagtggtccgtgcggtaaccagtaccatcccgttacgccgtctgggtaaatgtgaagaagtggcgaacaccatcgtcttcttaagttcctctgcctccagctacattgtcggccagaccatcgttatcgatggcggcctggtcatgcggtgatttatgtctaaatacacgattccttcgaaaatcttcctcgaaatgggcggctggcgtcagccgctgctgatggtcgataaaattgcagattataaatacggtgaaaatggctttgtcagtgtcgtgaaacacgtcacctataacgaaccgtatctactggggcatttcccggaagatccgattatgcccggggtgattatttcggaaatcttcggccaggccagcgagtatctctctttcctgaccgacatttgcgatatctggcgcgaacgttttgaggaagagctgaagtcgttacgtgatattcacgcacgcattcaccgccctgaaatgctggagattatccgtacctggcgcagccaggtacgcggcgtgctggcggctcagaacctgaaatttaaagatatcgcctatccgggtgattctattgatgttgtcagcaaattggctttttcggatgccagtggctttaaacactattccgtgaccgcgtacgtcggtaaaaagctgattagtcagggcaccattatcaatttccgtgaaaccaagtaatccaataagagagtaaatattatgtctaccatgaatgacgctattgaacagcgtaaagaagttctgatgaccattaaaactgagatcatccagcgactgaatattcaacgcgatgaagcgcaaattgatgatgatactgcgctgtttggtaatggttttaaactggactccgtcgatgcaacggaaattgtcgttctgctggataaagtatttgatatcaagatcagcgaaagtgacgacccgtcctatatgcgcagtatcaatagtctggccaccttcgttattcaaaagaaaaacgattaactacttattaaagaattaattatcaggacacgtttatgaaatctcttgctgaatttcacttgaaaaataatgcggtaatgggggtatataacaaccgtaccctaccttcttcttatcacgatgctatgaccgaatataaagccgttcgtgaaaacgcgctgctggtggactattctcacctctctattgttagcgtcatgggcgatgatgcctgggcgctgatcaaccagctggtttccgcagatgtctccatcattcgtgatgagcaggcaatctactcactggtgttgaatgaagagggcaccattcgcggagacgtctatgtgctgtgcagcattgacggttattacctgctttcagaagatatttcggctgccgaattgatcgccagcatgaataccattctcgaaaaagcggaagaactggatattcaatcgatgcctgaaattcaggatatgcgggaaaacaactggggggcaatcctgctcgaaggcccatactcctgggagatcatgtctgaaattcatggctttgacgtgattggcctgccttactacgaatacatgaataccgaggaggatctgctgctcttccgctgtggtaaacacggtgagtatgcgtacatgaccatcggtgagcaggcgaaactggcggagcagtgggaaaaactgttaaccgttggcgagaaatacctgatgcagaccggcggcctggattatcaaaaaatcgtacgcctcgaaaatccgtgctgggatgccagcctctgggaaggtcaggcggtgaatccggttcagttgcagatgcagtgggcggtgcagtacgacaaagatgattttattggcaaggacgcggtgacagagctatcccaggagtataccggtaataaactcatcggcatgatcgcacaggaagaatgcgaaggcattgaggctggcgatcgcgtgctggtggaaggtcaagacgtgggctatgtcgtgaaggcactcttttccccagcgttgcagcgtttcattgccctgaccctgctggaaaaggattacgcctggtctgacatcagcggctacgaaattcaaattgctcacggaattattccggcgcaatcaaaatgtatgccgtttatttataacctgagcatgttggttagcccaactgagcacagttatatcgacgcgtcaaaaaataaaagcgcagcgtaatgaatatcgccgcgtgactatagcttacgcggcttaaattaaccccaattggcgggattgccaggtattattcatgaaaacgaacaggaaaagagttgttattaccgggctggggattttgtcctcactggcggaaaatattcaggatttccgggaagcattattaaataaaaaaaatggcgttaaggatagcgaacgctttgcaaaatggtttgaaaatgcgcgtgcggcagaagtgttgcatgacattgaatactccgatctgaacgaagatgttatcgattcactggataacgcagcgctctgggcctacaaagtgggtaaagatgcgctgagtcaggccggcctgatggatagccgtgacaccctcaaagaaacaggcatgatcgtcggtgtttcgtccgcgggaacagaggcatttttgccgctgttcgaacagcgcatggaagatttctcgctgcgtaaagcactcttttccggcgcattctcatcctgttgttccagcgtttcaacgctgctgggcttacagggtggggttgaactggtggcgaccgcgtgtaccgccagcccgaacgccgtggggatggcctttgactacatccagaatggtaaaagcaaaaccatgctggcagtgggcactgagcccatctatctgccgacctttgccggattctacgcactgaatgtcatgcatccagacacttgtacgccgttctcgggtcagtccggtatgtcgattggtgaaggcgctggcgctatcgtgctggaagagtatgagcacgccgtagcacgcggggcgaccatttatggtgagatcctctcttacgccacttcctgcgatgctttccatgaaaccgggccagatccgcgtgccagcggagcggtgcaggtcatgaacaaggcaatggcaaatgcgggcgtaaccccggagcaaatcgattacgtcaacgcgcacggtacgggtaccgaagccaatgaccgtattgaaacgctggcaatgaaaaaggtcttcgctaaccacgataaactgctggtgagctccaccaaatcttactttggccacaacattggcgcagcggggattgtggaactgattgcctgtctggcaacgcttccggataaccgcgtactgccgacgctgaatttcagccatgcacgcccgaattgcgatctggactatgtgccgaatgagtttcgcgatcgcaaagtgaacatcttcatgaagaataactatgccttcggcggcaacaactgctgcatgatcctgagcatggagcccgcgtccattccggtcagtacctatgattcgaagcgtgtggctatctcgggcgtcggtgcagtatccgcaataggccacacgctcaaccaggttctggaaaacatctgggcgcaggaccaccacgttgaactgggtagcgtaaccttcccggacgatacactggaagaagccaaagagctgctggccgtgctggatgaatcaaaccagtttgccgagctgtttgatgaagagtacagcttcagcgaagctacgcttccggaaacggaaagcaactttaaaacgttccaggtttccgggctggagccgcgtaaacacctgcgtcgtttcgatcagcgtaaagcgacccgtggcggcacgtttgccctgatcgcactcaccgaagcgctggaacaggcgaagcgtaaaatcaaacgcgacggcgatgagttgggcatgatcatggggatgtcccgcggcccgcaggaaaccacctacaaatatctgcaaagtctgaaacccgatccacgcaaagtacgtacatcggaatttcctggctcgctgatgaatgcgatcccaacgttctgcgggatctctgaagggatcaaagggtataccactacgcttgcgacaggggaaaactcggcgctgggcgcgctgacctacggttatgaaatcgtccggcagaacctgcaaccgcaggtattggttggcggcgcggatgagtacttcccgtcgatgtcgctgtatatggatgcggtgacacaaaagatccacatgacggctgaggcgagcgactatcagatttacggtaaagatccgcaaggttatgttccgggcgaaggggcttgcatgctgctgctggaagatccgcagttggctgtggcgcgtggcgctgaggttctcgcggaagtggtgggctacggcaagtcatgcagcaatacctacttcgacgcctcattgttggaagaaaaatccgcgtcgatggcgctggccattgaacgcgcccttacgcatgcgggcatctctgctggcgatattgatttggtatgtggtaccagcaacggtagcgatgaccattctcgtatcgaaattgacgcgatttacaacaccttcgccgcgcaaaacccggcggtgccggtagtgaactataacgcttgctttggttttgtcgcctctgccgctggtttgcttaacctcgccgtgattactgactgcattaagaagcaggcagtacctgcgattccaaatacggtggaattctttgatgagcgtgtgaattttgtacgccagtcgatgaaacttgcgctgaaccatgtcctgcttgttggcgcaacggaaggcggcaactactacgcgttcgtcattaagggataagactgtggacaatgccgctattatttcgggttacagcgtgtggatgccgtatgccgaagactgttcgcagttaattgacaatctgaaacaggggaaacgcgttgcgcgtacaccctggtttacctccaacgaggaagccattaaatgcgggtttaagggtaatccgtcagtggcgacgttgaaacaggtggacgatagcgcattggacctgctgtctcagttgatcgacgaagccctggaacaggcaatgctggataagcattgcctggccgggcgcaacgttcgcgtttatctgaccggtattgggccgcgtatcgacgggctggattacaaatctttctataattacaacgatgtagaagatatcaacttaacgcaatccatcacaaatctgcatgcctcaaagatgtcgcaggacacgatttcaagccatcttgcgcgcaaatatcgcttgcagtatttgccgcctaacatgaactgcaccagtaactcgtcactgactgcggtgcatctggcgacgcagggcattgagcagggcgggattgatctcgcgattgtgctgaactgttcgaaaattaaaacccaggacatctggttcctggaaacgcaatcgatgctggacagcgaacaagtgcagccgtttggtgaaaacagtaaaggtgtggcgttcgcagaaggttttagcgcgctcctactggaaagcgctcatcaccgccgggcgcgtcaacaaagtgagggcgtaagggtgcaaacgacttacacccaaatcagcgcgggccgcagcaacgatgcctcctggcttagcactaacgtgcacaaggtcatgcaggccgcgatgaagcaggctgaaattgcgctggatgatcttgcagccattcttccacacggcaacggttcggcagtgagcgataacgcggaggccaaagccatcgccatgttcgcaggggagcgacagatccccgttctcgcctataaagggcagatcggctataccgcaaccggatctggtgttgtcgatctgatcattggccaccattcgttgacgcatcatcaactgatcgcacctgttggcaacgacgtcattatcgacagcatggcttcgctggtacttacggacggcagcgtgacaaaccatagcaaacgccatttgctgaaggttggtgtgggtgtcgatggttcagttattggcgttgtcatgacaaatatgcaagcggggcgcgcgaaatgacggaaaagagtatctacctgtcttcctgggcgcttacggaaccggacgacattttttatttttatcagccgacctggctcaacgcctgggaagcacatatgtacgaaaggggattatacggcacccgtgctaatggctggggactgaagcgctttggcgtggagaacgatatttatgcaccagaacggatccgtaatccacaatatatgccttaccttgaggcgatggagcaggtgaccgattctgcattacaacaaatgccgactaaagaacgcatgaagttaatgaaatcgcgcacggcatttatttatgccgattcctggggcgaatccggttcgtttgaaaaaatttccagtgcgctgcatatcgccactattgatacgcttcccaagaatttacttaagaagttttcgataacggaaccgacttgcaagattcgcggcgaaaaacaggcattcgttcaggcgctgcgtatggcgcaggattatctcgcctgggatgtattcgataacgtggtgatttgtgctgcctatcgggcaattccggtgctggtattctctgaagaagatgtgggtaaaccgcctaagcgtttatttccccgtcgtgctgatgaggtgaatttatctgttgaacgagtgggttgttttattctcagccagcgtgagagcgccatcaggctgcaatgcggggaatatcattccggcactgcgccacagcatgctacggatattgatgtcatggccttcagcgaacggcaacaaatgccgtcccggcctgctgctggcgttatcgacctggtggcccattacggtgaaagcggttgtctgacgcccgcgttgagtatggattatttaacccgtcatattcagcccggtggaaaaatgcgtacggtcattgccgataaacagtttggttatcactactttgaccttgaataccttgaaggataacgacagtcgtatgcaatctactattaaatcgttgcccgctatttcgcttagcaatatttataagtgttatggcgctggggcaggaaaggttgatgcgcttaaaagcattaatcttgatatcaataaaggcgaatttctcgcactgtgtgggccgtcaggcagtggtaaaagtactctgttgaatattctctcgggtattgataaaccgaccagcggaacggtgatatttttaaataaattactgaaccaactgccagaagagcagttggctgtgattcgtggaaaacatttgggttttatttttcagttttttaaccttatgccggtattaaatgttttcgataacgtttatttcccactggtgcttaatggtcagttcagtaaaaaagaagccactgaacggacgctgcattatctcgatagtgttggattaagcggttttggcgatcgtaaacctgggcaactatcgggcggtcaacaacagcgtgtcgccatcgccagggcactggcccacgaaccgatggtggtcattgccgatgaaccgacgggaaatttagacctggcaaccggcgaggctattttggacctgttgttgacgattaatcagcagaccggcaccacatttgttatttccacgcactccagcgaattaaaagcgcgggcacggcgagtggttgaaattcaggatggagtattgattcatgactcagatgcataaaggatttttgctcatcggcgtctttttgtacgcggcgtttgtggctccgaagatttacgcggcaacacccgacgctgttaaccaggttctgcaacaggggctcccggcgcagcctgccgcgctggcgacgctgaccgaggcgttaaagaaagagtatgaagccaggcacaatgtggtggcgctggttttttacgcctatggcttactgcgtcaagcggacggttatgcggcaacaaacgattttatccatgcctcagaatacgccaaaagcggctttttctggctggatgaagcggtggatttgcaggagaaaaatcaacgcgtacggtatttacgcgcccgcgtagatgcctatttacccgcagactcagggcgttgcgtggtgacagtcaaagacaccgaacacatgctggctgacccggcgatatggacgacaacgatccgcgaccatattctggcgatgcgttatcgcgcattacgtcactgcaaggacaccacccgcgcgaatgcgttgttggcgcaaattaaagggcaaaacgccgcgcttgcgcagtcgctgacgcaggattttaatgttgtaccagaatgggatagtgaagagttaacccaggtactgctgccgctgatgaaaggtgagtaaatgtccggggaaattttagctgttaattgcgttctgctgctgattctgttttttgtgttttatcagcttctgttttattcacgagatgtcaaatttgcatttttgaatctctttcgccacaagcgtcgctctttttctaccataaccgctattgtattgggtggcgtggcaatttttttatatggcggatttattgattactctttctggatcctgaaagagcagacgattcgtaccaatattggtcatgtacaaatttacaatcagcactattttgaaacgtcgaataaaaataagagcctgattgccgattatgcggcgttaaagaaagctattttgtcggacccgacgctggcggcggatatttccacgctctccgggcaactggagtttactggcgtaatttcacattacgagagcgaaacctccagctatttctccgcgctgggggtcgagccgttacccgctttaaagctgggttcgttcgataagattatcgcggggagcgatctttcccgggtaaaaggtgatgaaatcaccctgggcagcggtctggcgaaaacgttgaatgcgaaatatgacgactggctggatgtgatggtggtcaacacggcgggcgggcagggcgcattgtcgctaaaaatgcgtggcatttttgagtcaggcattaaagattatgacgatgtcgcgatgaagatcccgctggacaccgcgcagcgcatgatgggtacggatggcgtcagcaaagtgcttattctgcttaaagaggatgacaccgcggcgtttagcgcaaagctgcgtcaatttatcgaacgcaatcatttgccgctggtggtcaaagactggcgtgatgtttcactcttttatcaacaggttgaagggttgctatcggggatctatttcttcatcaagctgattgttgcgctgattgtcatcttcatgatcggcaactcgatggcaatgaacattgttgagcgcacccgtgaaattaccactctgcgtgccataggcctgaagccgcttcacgtcacgcgcttgtttctgacagaaggcatttttattggtgtgattggcgcagtcggcagcctgctggtggggggcgtgttagcctggattattaatctttatggtattgcgatgccgccatcgccgggacaaaccatcggctataccgcctttataaaaaccagtaacccggaattgatttgggtgacggtggtattacctattttgacagcaacaggtgcctctgtgttaccggctttacgtgcttcccggctgaatatttctgacgcatttaaattctcatagggctaattatgaatatggctttttacggcaagtggtttgcttgcctgtggctcgctacgtcgtgcgttcaggcggcgagcacagataataaggcgctggagataattcgtcgcgctgacgaaattcgttcgccgaataaaccgtttcgttacacgctgacggtaacggaatataaagcgggcgcaacccagccagagaataaacaggtcctcgatatttccatgcgctttatgaaaccgcagggtaatgaaaaagcggatgcacgctcgctggtgcgttttatttatccgccgcgagataaaggaaaaatcatgctttccgactggtacgatttatggttttacacgccggaactgcgacgtcctatgcctatttcacggcaacaaagattaattgggcaaatctctaatggcgatgtcattgtcactaactttgaatatgcctatgactcgaccctgatgggggaagtcacgtgtgctgaaaagcagtgttacaagctggcgctggtgcgtaaatcggcggatatcacctggccgaaggttatctattacgttgaaaaagacggtgataatcgcccgtggaaggcggcctattattcgcaggatgaccagttaataaaagaagtgttgtatcaggatttccagccggtgttggggaaaacgcgacccatgaaaataaccgttaccgatgttcgtcacggcaataactattcagtgatggagtacagcgatgttcgtctggaatcgctgccggagtttcatttcaccaaagagtatattcagcgaggtgcgaaatgaaacgtacgctgaagatctcttcgttgctgtgtgttgcgctgccgttgacggtacaggcggattgcctgtcaggtgacgaggtggcacaaaatagcgatgtgacgctttacgagcaggtgtcttatgtcaataaacaggcttcggcctggcagattgcaggcaaaaatccctacacccgtcacaacggttatcaggaggcggggattggcatcaatagcggttgttcgataatcgacaatacgctggaccttaagctcaatctgtatggaataaacgaatatgcgcttaaacccgcagggaaattcgaaacggatgatagccgcacgcgtgcgttaattaaccgcctcagtctggtctatagcgcctcggacagcgttcaatttgaagcaggcaaatttgccgcgccgtcaggaatgttctttttgcgttcgccttctgatttgcaaacgcattattacaccggattccagtcgacgcgtttgcacgatcccaaaatgacatcggcgtatcaggcgtcatcgtggggcgcaaaaatgagcgtggatacacgcgattatgcgttttcggcgagtgtcataccgaagttagccaccatcgacaaacgctatgtgacgtctggcaactggtcggctaatcagcagggaaacagcgacgaagcctatctgctgagcttcagcgatcatcgctttggtgagcacacgccgacagtcaatgtgcggctcggaccatcgccgtcactcgcgctgtctgacagttatcactacaccccgcagcttacgctgaatgtcgacgcagcctaccaccgctcccagcaatggcggcatctttcccaccgtgagacggcgcaggtcgaggaatatcagtttccggattcgctctatgaaacgaaagatgaaagcggcgtagagctggcgctgggtgggcagtacaccagtgataatttcagcgtgtttggcgttgagtattactttcagagcgagggttattcgcgcgctgaacagcgtcagcagcgcgagttaattgacttcctcaataccacaaccggctatgcgccactggatcaggcatttgattcttacaaatacctgatggcttcagaaatcagcaataccgccaatcaggggatgctgcagggtaagcactatctgaacgcctgggccagtctgccgctggcgggagagtcgacgctgcagccttcgctggtggtgaatctcgttgatggcagcacgttgctgggcctgcattattccacgccgctcagcgctataagtaaccagcttgaagcctatgccggtggctatagcgcgctgggaagtcggtactccgaatttgcgctttttggcgacacgttaggcctttatttgggctttaaatactatctataaggataaagagatgatgaataatgcttcacaaccgacagtactgctttttgccggtcagggtaatccggttattggtatgggcagcgatctttgggatctcaacgccagtacaaaacatatctgggattgtgccagcgatatttccggactgaacctgcgtcgcctgtgtcagaaagggccgatgaatcgccttattcaaacgacggtacaacaactggcggtgaccgcaattaatgtaacgctctataccctgtgccgcgagcgtcttgagaatttaacggttgtgggctcctgcggacacagcgttggtgaatacagtgcgctctacgccgctggagctatttctcttgagacgctatttggcatgattcacttcagagccagcctgatgcatgacgaaagccagagaaataaaggcgcaatgctggcggttaaaggcatcaaccgcgaacaactgcagacgatgattacggaatcaggcattgcgctggatattagctgtgataacacgccgcgccagcaggttattgggggaacgcaggctgcgttgaatgaatttgccacgctgctgatggccgctggatacgaaccggttaaa

SEQ ID NO: 65 - DNA  (genomic), 988 bp; double-stranded, linear
accgcctgaaataaatctgacttaatccaggggtgttatataatttcattataaacaatgtattacactttttgttgtccgatattatctaatgtattcttagtgaagcgagagactaatggcatactggatggcataccagagtgacgggaattagcgtatggcagtattgacggatacgaaagcaagacatatcaaacctgatgacaaaccattgccccatgggggaattaccggactgacccttcatccttcttcagtaaaggggcgggggaaatgggtttttcgttatgtaagtccggtgacacaaaaaagacgtaatgctggattgggaacttacccagaggtcagtattgctgaagctgcacgtactgcccggataatgcgagagcaacttgctgcaggtgatgatcctctggagattaaaaaggctgaatctgagaaagtcgctatcccaacatttgccgatgcagccaggcgtgtacatgcagaactgtctcctggatgggaaaatccaaagcatgtaaggcagtggttatcgacgcttgagaattacgcgtttcctcaactgggagcaaaaacgctggattcgattacggctgcggacgtggcagaaacactgcgtccagtctggttaaccttgtcagaaacggcaagccgggttaaacagcgcattcatgttgttatgcagtggggatgggcgcacggtttttgtgtagcaaatcctgttgatgtggttgaccatttgcttcctcagcagacaagaggacgtgatgaacaccaacccgcaatgccctggaggcagttaccgctttttgtggcgaccagtgtgtataccgatgaaccttataatgttacccgcgcactgttattaatggtgatacttacagcaactcgctcgggcgaagccaggggaatgcgctgggctgaaattgattttcataagcgggtatggactatacctgcagaaagaatgaaagccaggata

SEQ ID NO: 66 - DNA  (genomic), 9827 bp; double-stranded, linear
gggggcacccggtgtgtggttcgcttacagcccggacagaaaaggcatccatccgcagactcatcttgcctgcttcagcggtgtgctgcaagcggatgcgtacgccgggttcaacgagctgtatcgcaatggtgggataacggaagctgcctgctgggctcatgcccgccgaaagatccacgatgtgcacgtccgcatcccgtcagcactgacggaagaagccctggagcagatcggtcagttgtacgccatagaggcggatataaggggaatgccggcagagcagcggcttgctgaacgtcagcgaaaaacgaaaccgttgttgaaatccctggaaagctggttgcgtgaaaagatgaagaccctgtcgcgacactcagagttggcgaaggcgttcgcgtacgcacttaaccagtggccggcactgacgtactatgcgaacgatggctgggtggaaatcgacaacaacatcgctgaaaatgccctgcgggcggtcagtctgggtcgtaaaaacttcctgttcttcggctctgatcatggtggtgagcggggagcgctactgtacagcctgatcgggacgtgcaaactgaatgacgtggatccagaaagctaccttcgccatgtgcttggcgtcatagcagactggccggtcaaccgggtcagcgaactgcttccgtggcgcatagcactgccagctgaataacacatccccgtcaatacggccctcgctgtacgcttaccgaaaaacaactttttatcttttttgtttcgctcaaattagtataaaaagccgaccaccaaccaataaaaacccatttaccatccaatagattatgatggcttcaatctaaataataggctatataatactgcaagaccacaacacatgctgtcactatgagtcaactatttagatgatattagtgacctgtttcagagcattagcgcaaggcgattctttgtcttcttgcactaattttttatcataaaaatgttcctagcactgggcatcaatatcgcaggtcagaaagagctcctggggatgcggctggccgaaaatgaaggggcgaatttctggttcaatgtgctgactgaactgaaaaaccgcggtctgaacgatatcctcatcgcctgtgtgtatggcctgaaagaattcccggaggcccgcatccagttatgcatcgtgcatatggtgcgcaacagcatgcgcttcgtgtcatggaaggaatacaaagccgtcactcgcgacctgaaagcgattagcctcccacagaagaggcaggccagcaggcactggaagcgtttgctgcggcctgggactgccgctatccgcagataagccggtgctagctgtcaaactggactaacttggcgacgtttttcgcttatccggcagatatccgcaaagtgatctacacaacgaacgccatcgagtcgctgaacagtgtgatccggcatgccatcaggaaacgcaaggtgttcccgacggacgagtcagtaaaaaaagtggtgtggctggcaatccaggccgcgtcacagaaatggacaatgccgttaagggactggcgaatggcaatgagccgctttattatcgagtttggtgaccgtcttgacggtcacttttaagaaaaggcatttacacagaatcctaaacaggctcacaggcctctaatcatccacattgtaaagatcctttgttgtaagtaagatctggtaccctaataatatcaaaaggattaaaatcatcactgcatccttccacgaggcatttcattgctcgtagatcaccatatagctctgaagagtgatgcggacatagcagattataaactttacatttcgaatcttctttgccttgtctactttcctcaatttttactttcaatgaatgcagaaaaaaaagatccctgatataactatccctgtcctctatcgtcattcccgccctcagcgctccgacaacctcatcagtattttcatttctcacctcaaatacactatttctcttatccatcagcccacttacaaaagcacttagctcttgaaaaatttcctcaagctcattattatttctggcacatgaatatatagagaccataacatcaagtttatcttgtaattcaggagaaagaaagtgattatgattaagctcacttactgattccggagtcgaagggttacctcttcctgatacatacatccatgaataaagatttgctgaagaaccacttgttggtaacatatcaaaacccccttaacaaataaatccataaatattattgcaactaatatatctggataaaaatattatatcttacttaatactacactaataagatccagctttcctccgtgataagattgcatgacttgatgttcactccatgaaatatcagaaacattataagatgatatatctattggattaaattcatttctcatacgatcatataaaacatttgtttctgttgtatcaacaaaaagaattccttttttctccagtctgtcaaacatatcgtaaatagcctgttcagcttgtgctggtaatgatggaatatccaaaagagattccccatttattttattcattctaataccaataacatttccattatcattatatattttctctgcactcccggaaccataatactgattgaaacaacgaacttcgcttgtcacctcttcatggctttgagatatagtaaacatcttcaacacttttgttgtatcttccatatcttcatacacgacagcattaccacctttaccaataacattacctggcacgggtgatttattgttgctaaccctcggcaactctgattgagtataatccgctggaggtaactccggctgcgcataatccactggaggtaaatcaggtctgttcgaatgaacagagcctctttctatagtcgtgctcactggcgatgtattcagcatagcctcaatttttctgctaatctctcccttaggccatcccaacctgtgcaacagattagtaaaacaaccactatgactttctcttgtaacgcaaaacttattatcagtgaccacaacacgatatgttctgttgccaaccgttacttgcgtcccgctatcagagtgaacagcagcatcccttacagaggataaaacacgattatcaggcgaagtcaggtttctggttaaagaattccatgaacatcccaaatttatagaagagggcgataacatacatttcaaccttcaaaataaacctatctaattattcctaacagacatcccccatacatgacaacaaaaaccggagccggactccggtttttgtgaagctatcgggttacttcatttcgccaatattttcccacttcccgtcagcacgcaggatttgcagcggtcttactacacactgacccgaggacgaaaaaagagttcgggctgggaagagacagaagagtagcaatttcagaagcattcacaccaacattgagcttttcagcgaaagtgggcacgaatcattgctggacagggttaaaggcactgactcaatcactcttcatacgtggcttgatcgatatgaaacaatcctcagctagagggggagcaagccgaaaacattactcgactacgccagcaaaatcagggcaattcgaagaaaattgccggacaaaccgctcactgacatatcaacgaaagaggtggcagcaatgctaaacacctacgtcgcagaaggtaaagcggtttccgcaagagtaatcaggtcaacccttgttgacgtttttcgaggggcaatagccgaggggcatgtggcaacgaatccagtaacaacaacccgtgcagcaaagtcagaagtaaggcgctcaangctgacagctaatnagtatgtcgctatttaccatgctgctgancacctccccatctggctgaggctgtcaatggatttagctgtcgttacagggcagagagtgggcgatttgtgcagaatgaagtggtcagacataaacgatggtcatcttcacattggacagagtaaaacaggagccaaaattgccattccgctggctctaaccattgacgcactcgacatctcactggttgatacactacagaaatgcagggaggccagcagcagtgaaacaataatcgcatcaacctatcacgaaccactttctccagccacagtatcacggtatttaacaaaggcgcgaaatgcatccgggatctcgtttgatggagacccaccgacatttcatgaactacgtagtctgtccgcgaggctatatcggaaccagattggctacaagtttgcacaacgtcttcttggacataaatctgattcaatggcggcgcattatagggacagtcgcgggcgggagtgggacaaaattgaaatcggataatgattttattttgaccaataatgacttaccagatttaacaacttgatatttaataagatttttgaacgaacaacttccatgtcagaaggaggataaaatcacaaaaacacattaaaaatcattatgttatttatacaattgattaaatgatagactgcaaaacgcgacaaaacactacatttagagtcacaattaatcaatgagttagatgtgattagtgacctgagacagagcattagcgcaaggtgattttttgtcctcttgcgctaattttttgtcatcaaacatacagccaatcagaagagcataaagctgccaagcattatatgtcttagttttatgctcattttcattaaaaaaatatataataagactaatatcagtataaaatatttataacacttagagtaaaaatgtaatcagcttatacaaccaacaataatttaaactataaaaaacaataacagaaacatttataatttattttaagtgttcaagcgataaactggtaaatttaacaacttaattttgagatctaagtcacatcaatcaagcattcaaacagttatatattaaagctgtccacatcggatatgtgacactaatagtatcaatggattgatattattaatggatataaacatgtaataaggatttattatgaacattcaaccgaccatacaatctggaatcacctcacaaaacaatcaacatcatcaaacagaacaaataccctctacacaaataccgcaatccgaattacctctaggatgccaagctggatttgttgttaatattccagatgatatacagcaacatgcaccggaatgcggtgaaacaacagctctactgagcttgataaaagataaaggtctgctctcagggctagacgaatatatagctcctcaccttgaagaaggatccataggaaaaaaaacattggatatgtttggtttattcaatgttacccaaatggcattagagatacctagttccgtttcaggcatctctggtaaatatggtgtccagctaaacattgtaaaaccagatattcatcctacatcaggtaattattttttacagatattccctctgcatgatgaaataggttttaattttaaagaccttcctggcccgttaaaaaatgcattaagcaacagtaatatatcaaccactgcagtgtcgactattgcatcgactggaacatcagccactacttcgacggtaaccaccgagccaaaagacccaataccatggtttggattaacagctcaagtggttcgtaatcatggtgtagaacttcctatagtcaaaactgaaaatggatggaagcttgttggagaaacaccacttactcctgatgggccgaaagcaaattacacggaggagtgggttatcagaccgggagaagcagattttaaatatggtgcatctccattacaggcaactctagggctggagtttggcgcacatttcaagtgggatttagataaccctaatactaaatatgccgttcttaccaatgctgccgcaaatgcgcttggtgctttagggggatttgcagtatccagatttgctagtacagatccaatgttaagtcctcatatcggtgcaatggttgggcaagcagcagggcatgccatacagtataatacccctggattaaagccagacactattttatggtgggctggtgcgacactgggggctgccgatttaaacaaggccgagtttgaagtagctagattcactgactatcctcgtatatggtggcacgcaagagaaggagctattttccccaataaagcagatattgaacatgccacaggtgctgatatacgcgcaatggaagaaggtatccctgttggacagcggcatccaaatccagaggatgtggtaatcgatatcgaaagcaatggcttaccacatcataatccatcaaatcatgttgatatctttgatataatccaagaaacaagagtctaagctttaacttgtttattttaaaataatagctgaaatggatggcagctattattaataaggattaatatattttttctaaaataccccacaaaataaacacatcataaaaattctaaatacacacacctaatctcaaaaaaaacaaacttactatttgacttggattatgtttttaatccaatattttccgacaacatctccacagaaaaatgcatttacataaagacgccttcaagtcatctgaaacctgccaaccacagacaccttcttatattctggatgtctgcggcgtttttttacaaattactgacagccaatactctctcagagaaaaatattttaactatcttttataatgaagtttcccttgataggatcataaacacatttatcaggacttataatcattgatgccgttattggttctcgggtcagtggatgatatgagccttcactagctaaacgagaaaatgcatcaaaatcaaataagcagcatactgccgaactatctgaatttttgacaaacactccttcttcgggtctctctagtgtaattggacactgaatagactctggcgggcactggaaatttcctgaactaacaggaaacttacattgagatattttgtcctgaatactctcttgcgattgtgcttcacctgagtccgaaagcatactgagcatcctatcgcgaagagcttcagggccgttattaaacccataaaggaataactcagtaagcaatcccccactactgccgctggatagaaaacgcccatcggtttcattaaatacaatgctgacagtctcattacctaatgtaaactcccctcgaccgctagatgctacttgagctcgaaggacattcaatccattaaaaatgagcttgatctaatctccgaatttaacggcattataaaactccctattttaatttaaactccagacttaaatagctttaacaaacatctgccttacatgacaacaaaaaccggagccggactccggttttgtgaagctgtcgggttacttcatcccgccaatattttcccacgtcccgtcagcacgcaggatttgcagcggtcttaccacgcactgtatctgctttttatccgcatccagtatcaccacctgcgtgattaccctgtcctgctccggaataataccattctcatcggactccaggatgtctgccggccccagacgcagttgtgctgtaagtaactccccgtcttcacggtcatcatgctttccgtgcccgcacagacgctgcataagtttttttagtatgttcatgtcattctcctgttctgcctgtatcactgcccacttcatcaagccccttaacatcctgccacggcccgtcaccaaacctgacctgcaaatgctgaaaaaaaccctgaacccgtgtggtatctttgggggcaagaaaggtcagtccggtgatgagcgcaccatctgtacccgggaaccagccatggctgtttgtctcaataatgctcgccggccccagacgaaaacggatttgtgtctcccccgggtcgcccttcggtccctgaggtccggttgcccccaccgggccagccgcacctgtttctcctttcggtccctgtgggcctgccgggcctgctgccccggtgtctccctttggaccctgtggacctgcatttcccgtcagaccggtctctccccgctctcccctgtcacctttcggcccctgcgggcctgccggaccagcatcacctgccggtccccgttcgccggttgcccctgccgggccggtgtctccacgctctcctttatctcccttcggcccctgaggacccgcgggccccggttccccctttggcccgggaggccccaccacggtggggattcggtttacggcttcttccgccgctatcctgctttgttccgctgactgtgcgctttctgctgactcccgggctttttctgctgcggtcgttgcatccctggctgcattaccggctgcactttctgccgtcttttttgacaactcagcatctgttgcactttgtaatgactcactggctttttgagcggccgcagaggccgaggacgaggacgcctcctctgactgctttgcagcggctgcactttctgccgcctgccgggctgactccgatgcatcccctgctgaagtgtcagcatttgcagcgttctcttctgcctgactggctgatatgccggcattcctcgcggacgtctccgcctctccggcattcttcttcgcctcctcagcgtgacgcgccgcttcttccaccatcagttcaaaacgacgcagtgcctccggccggacgtcatcctccgacatggcaccgagaaaatcattcagcgtaccgggttgagaatcttcatacacggtgatggtcccggcatgtgacggaggaaatccctccaccaacagaatgacgctgtactgaccgtactcaacatccatgctgtaacgtccggcttcatccggattttcagaggccaccgtgttcaccaccaccgtgctgctggttcgtctggccttcagcacaatggtgcagttctgtactggttttcctgtgccatctttaagcacgccagaaatttttactgtcatacttttccaccaataaaaaaagcccgcagcagtgacgccacgggcttcaggacagtgtaactttacgtttcctcaaacgcagttcaccccataaggtggatgaacctgcgtatcataacaatatttacagaagataaatcggcgtctgttgtcagaaacggtatccgataccaacaataaatgcatccgatcgccagtcgccactaccggaaccttcataagcaaggtcaatggtcacggattcggtcgggttaaactgcacgccagccccccacgccagagacgtgttgctgtggcgaccgtcatcacttccggtcagcacatcgtgcgttttccccttgttgtcagttacgcggagataatccccgtagaaagtcgacacacggctgtaagccacacccgccatcgcatacgcgctgaaccattcattcacgcgtacagacggccccgccatcacgctgaaccagcggttacgcacggaatcttcatgccagcgggtatcgctgtagcgcgttttttgctcatcctcagcattggcataactgaaggacgtaatcagccccagcgcgtccataaactcataacggtatttcacgttaatcccgttcagatcatcactaccgggaacgttcgtcgaggcatggagataccccgcgctcagcgtggactgatgttctgctgcactcgctggcgtagcagcggggacctgccagactactgcggacaaaataacagcacataatttacgcataattacctctcgcttttctgcaataaaaaaggcgccatttctggcgcccgtatctgggttataaaattcaactaatcgtgatgcctgcagtggc

SEQ ID NO: 67 - DNA  (genomic), 1411 bp; double-stranded, linear
cggcttaaacgcctgggtctgtcaaaaacgttccgtcgtctggtcgtcacactcatccggcgttatggcgtcagtctcattcatctggatgccagcgctgaatgcctgccgggtttacccactttcgactggtaaccaggaacaacatgaaatcattaaccacggaaacagcgctggatattctgattgcgtggctgcaggacaatatcgactgcggatcgggaattatctttgacaacgatgaggataaaacggattcagcagcactgttgccctgtatcgaacaggcccgggaggatgtccgtaccctgcgtcatctgcagcttctgcaccagaaccggtgaagctcactcaccagacttcattcctctgacgccagcctgcacagggctagcgttttcatttatctgcaaaaaggaatatcgattatgtcagatatcacaatctcccgtccggaagtggtcaacgggcatacggacgttatctgctcaaccagcattcgccacattctggctgtacgaaagagtacactgttgcaaatcgacacacttatccgacaactggctgaaatctcggtgctgacggaaagcatcggaggtaaaactgccccggactgggccatgaaacaggattttcgctgcggctgctggctgatggagaaacccgaaacagcaatgaaagccattacccggaatcttgatcgcgaaatctggcgtgacctgatgcaacgttccgggatgctgtcattaatggatacgcaggcccgtgatacatggtaccggtcactggagtacgataattttccggaaatcagcgaagcgaacattctgagcacatttgaacaactgcaccagaataaggatgaggtgtttgagcgaggggtgatcaacgtcttcagagggctgaactggaattacaaaaccaattgcccctgtaaatttggcagtaaaattatcgtcaacaatctggtgagatgggaccggtggggatttcatcttatcaccggacaacaggctgaccgactcgccgatctggaaagaatgttgcacctgttcagcggtaaaccaatccccgacaaccggggaaacatcacccttcgtctggatgatcacattcagtctgttcagggtaaagagagctatgaagatgagatgttcagcatcagatactttaagaagggctccgcgcatatcacgttcagaaaaccagaactggttgacagactgaatgatattatcgcaaaacactatcctgatatgctggcagtatagctttgccagtatgctcaaagatcggaaattgtccgataagatatgatcgcggggcatataaaccggtttcagatggcatacccgatggcatactgtctggaagggaaaataaaaaagcgcatgttaaacaataacatgcg

SEQ ID NO: 68 - DNA  (genomic), 104 bp; double-stranded, linear
cgattgatgacattgcaataaaagcgagcggactgttccctcgcccctttggggagagggttagggtgaggggaaattcgcaccgccgcgtgcttctgctctgc

SEQ ID NO: 69 - DNA  (genomic), 26173 bp; double-stranded, linear
taaggcgggacactttcaggattttgaatttattcaattttttcctttctccaaaatctctccaaaacgtttccccaaaactaggccacgcattttacaacacttttttcctgagatggtgacggatattccatatggtgtttgtcaaataaccaacttaacccattcctgacctcgagtatcgttatagcgatcggtggttgcctggactttatgtcctagtaatgtttttgtatcgataccctgtgcacggtacagccgttctgatagagagcgttgttcatgaaatgttggcggagtttttcctgctggtggaattaccccagccagatcccgtgctttggcaaagtagtcgctcaggttgtctttactcatcggcttcggttgtttctggtgccgactatggattagatatggacttaatattctgtctcggcacccatcaataacttcttttaacgttatcccaatggcatcacagcgtagtgtaagcggtaacgccagacgcattccggtttttcccctgggtgatatgcaagtgttcgttccacacatctgaaaaacgcatgtggcaaatgtcatcacggcgctgaccagtaacaatcgcaagaagcattgcgttacggataaagtgtttttcaggcgttgcattgtaaattttttgccagtcttccatggtgagcctggctctggttactttagggatcggtttacgggtagcctccggaggattccatccaggaggaacttcccctgcatgctgtgcttctttataaatatcaacccataatccacgatttactctcgctgtactgaccatgtctttatccagccactcatccagtattaatgcaaagtctcttacttccagttctttcaatgggtggtttcccagacgggaaaccaggtatgcagccattcgagttttttctttgtgagttgtagctgcaatatctccatttttcagtcgcgtgtcctgtattttcagatatcgatcaacccatgcctttaatctgataccccgacgttttgttgctgacggactttcatcaattttgcgcatgaaatattcagcttctgctgcagctattcgctgatggctgtggaagcgattttttctgccttacctttgtctgttccgagtccgtgaaattttccagtcacaggatttttatactggtagtaaactctgccagttctgcgatcaaacttttcgtaaagaccggctacgtcagtgctgttttttcgtggcctcggtgacatgagttaaaatctccttcagtgcatcatcatcgccagtatgaatttccggcgcaattcccgtttcaccaggcccaacaaatactgctcggcgatctatcagccaacgcccacgaattttttgtggtcttggaacgatgtatcctagttttccgtatttcaccagggtagtgtttgttattgggagactgaaccgttttggtttccactcgtcgagcgttatcaggtactgttcgctcatggctatcactccggaacgcgccagttgcagaatatcaacgacaactggcgacggttgaacattaaaaatcagcctgactcgggatcagtttttgccagataactgaaacgtattttgcctggtaacgggcgtcatcaagtgcattatggcgctcaccttcgaatggaatagccgttctggcatcgaagtctatggctttccccagctcaacgattgtgcgtacatcgcgatcgttgtagtaacgccacgggcaggggatcccctgccgttcgtatgaacggcgcaaaatcgtgttgtcgaagttggctccatttccccagacctgaacaaaaaattcaccggagttttcgtcgataaattcccgcaattgtaacagtgcatcatctaacgggatttcatcggtcataatggcagattgcgcttcgcgtgattgcttaagccaccatttaatggtgtccctcgccgtgtgctttcgtgttgtgtgcctgctttttaccacgtcaggcgaggtggtccccgttattccccaacaacaaggatcttgttaatctggatatccccaacaacaataagagtattgaatgtgatcgctgaattaacggcagcaatgacggctattcgtgaaaccgcccagattgcaaaactaatgaacgaggcaaaaactcaagctgaagtaaatgcggctattggtgaactgaactcaaagcttgcatctattcagcgcgaatgcgtgtctctcgttgagctggtgggcacttatcaagaaataaatgcttctctcaaagctaaaatgcagaatttgaaaactttgaggctcagacggaaggttatatccttagccaacttgagtcgggaacttttgtgtactcgaaggaggtaaccgtgaacggcggcagcataatcatgcatctttgtccaaaatgttttggacaaaagatagtatcgatacttcagccattcccggttagagaatatgaattttttcataaaagcaggtgcctgtactgtgaaaatcagtttcttatgaataaaaatccggattacgtatcacctccatctattgaagagttggccagaaaactgaacggcaatctgtagatttttactgttatggatatccagattgttaaagagcatgccggatgcttgcttgtgtccggcgcgtgtgcaccactctccccccgtggaggattccttaattaccagatttcattagtcanagtttcttgctaaccagcgacncgcgccagattcggttttaaacgttttgcttttggtatacgtcatcgcggtgaacgtgccgtcctggttgggaaacacgccgcacaccagagattcgttgttgccaagatcaagagtatccatgctgacctcatatccccttaacgccggggtagcggaacaaaaacctgctgcatagttaaagttgaaccctgccgtcatgttcttacgcctcgggctggctacttaatccctgaccactgccgggtaactctaggtattgccctgtattgtgtgggacgggatgggttggtatgggaaaactataggaaatgcctaattgcttgtcaataggctacgcctaatgatttgggtgcgacctaataggtgatggtttgtgggagaggtagtaggagttaactaacgggaactaggaatttcccgtcggaccatataagtttaagttcctgtcttggtgatgttctggcttttccgttttgattcttgatttttcagatagttagctaccttcatttccattgcggcaatgtaggcacgaacgtcatgatcaacccaactaggctccgtagcatttccagataagaggaaagccacaattgctcttttttcatcagaggcggcttgataaaggctgtttatgtctaaaagttcactttttgtatctgaagtggatggggttggtatggggtattcgttaagcccccaatgctctggaccaaccacatcagaaaagaaacgccatagttctggaagtttgtctttacttatcgaacctttcttaatccagtcatggattgatggtggttggactttgaaatgacgtgcgatttccgcctttgatttgacggctcctgatgcaatttttttgttaatggcctgctctatcgctcggcctaagtctttaccactaagcattgcttaatagtctcctatgcgcatcgcattaggcaatgcctactctcgaagcgttaggcatagcctattgacaattgcattaggctaagcctaatattattgtgtgttttttggagttcattcgatgaaaaaagataactattcattcaaacgagcttgtgctgttgtcggtgggcaatcagcaatggctaggcttttaggtgtatctcctccaagcgtaaatcaatggatcaaaggtgtacgtcagttgcctgctgagagatgtcctgcgattgaacgagcaacaaaaggtggtgtcctgtgtgaagaacttcgtcctgatgttgattggacatacttacgacgctcgtcatgttattcgcagaatatgtcgatgaagcaaccaaatgacgaaaacgatcatacccgaagcatcaagaggcaaatgattcatgaaaatcaaacatgagcacatccgcatggcgatgaatgcctgggcatatcctgatggtgagaaagttcctgcagctgaaatagcccggacttatttcgaactggggatgacgttcccggaactgtacgacgacagccatccggaagccctggctcgtaatacccagaaaattttccgttggctggataaagacacccctgatgctgttgaaaaaatgcaggctctgttaccggcgatcgaaaaggcaatgccgcctctgctggtggcccgtatgcgcagtcacagctctgaatattaccgtgagatcgtcgaacggagggatcggctggtgaaagatgtggatgattttgtcgcagcggcgatcgcctggggcaccctgactaacagtgggggtcagcctggtaatgctgttgtcgtgcattgaccaacaatattcatgccggatttcttccggatgttcgagggtaaagttcggtatcagatgaggtgagtatggctaatgcctggctcagattgtggcatgacatgccaaatgatcccaaatggcgaaccattgccagggtctcaggacagccaatcgcaacagtgatggcggtgtatatccaccttctggtgagtgcgtcacgaaatgtcacgaaatgtcacggcgagtcactacgtggtcacattgatgtcacgacggaagatttagcaagtgcgcttgatgtgacggaagacgtgattgattcaattttgcatgcaatgcaggggcgagttctggatggcgatcttatttccggatgggaaaaacgccaggtgatgaaggaggataacggtaatgtttcgcaaaccgcaaaatccccggcagagcgcaagagagcgcagcgggagcgggaaagactgcgggagcagaacactgattgtcacgatgagtcacgacgcgtcacgcatatgtcacgacaagtcacgacagatacagatacagataaagaattaaaccccacacataacgcgcgcatgcgcgagagtgctccagccagtgagtcgaatggcgcgccgttgcagacagcagaacctgaatacccggatggcctgagcgaaccgatcgggaaatttccgatgactggtgtctggcggccgtcgctggattttcgacagcgggctgcattgtggggtatggctctgcctgagcctgagtttacacctgctgagcttgccgcattccgggattactggatggcggaggggaaggttttcacgcaggttcagtgggagcagaaatttgcccgtcacgtgcagcacgtcagggcacaggtaaaaccagtcagcaagggggtaagccatgcagcaccaggtggcaccgcatcacgggcagttcaggaaattcgggcagcacgtgaacagtgggaacgtgaaaacggatttatcagcaacggaaacggcctggaagctgtgggaacttatgggggaggtgtattcgaaccgctggacccagaagaacggggctgcgccgtcgaagctctggattgctcagattggcgcgatgactgaacagcaaatccggcaggtctgccgtcagtgcatggaccgctgccgggcgggtgaaacgtggcctccggacctggctgagtttgtggcgttgatttcggagagcggggcaaatccatttggcctgacggtggatgccgtgatggaggagtaccgtcgctggaggaatgaatcctggcggtacgacgggagtgataaatacccgtggccacagccggtgctgtaccacatttgcctcgagatgcgtgacagagggattgagcggcagatgacggaaggtgagttaaaacgacttgcagaacggcaactgacgaaatgggcaaagcaagttggtaacgggatgagtattcccccgatccggagacaactcgcatcgccgaagtgcccgcaagggccaacgccaattgaattactgaaacaggaatacgagcgccggaaggcggctggttttgtttgaatctgagaaacgattttgtcggaggaaattttaatggaaaccgtatctgacgcactgaaagcactgaaaagagcctcttcacatgtggtggcagctcgccttggaattagtcgtgaagaggctgtcaacgaactgtggaaactgaaacgccgtggagaagcggataacaagggggcgatatggtggctgactcaggctggtgaaagtgaaccggtgtcaccggtaccgaaagtgacggcgcaaatgctgacagaggcgattgaacaacatggcccacaaacggcggatgaactggcattgatgttcggaattacctcccgccgggcgaattcatcgctggcaatggcaatcagcaaagggtgtctgattcgcgtgaatcaggatggtaaatttcgttactgcataccgggcgttgatttaccggcagagccgaaagcagcatccgtagctgaaacggagggtaaagcccttcctcagccagctggtgttgcgttaccagtccaggaaacggctgcacaggaagaaattaaaacagaagcggtggaggacattgtgaagttgcagcaatcgttcactgaagcgaaagcagatgacctgattctaccatcgctgcatgtggctaaccgcgagctgcgccgggcgaaaagtaatgttcagaagtgggagcgagtctgtgctgcgctacgggaactgaacaaacacagggatattctccgggatattaccgccaccagagagcagcagcggtgagtggctggaagaagtggcgctgggctgaaatcctgatactccggcagtgtgcgggaacgatgagagtcgaaagcatcggttatctgattggccgtagtgagtcagccgtcaggacgaaagcgcgggaactgggtatcagcatgatgttacggggtgattatcaccagtcagccaaatgttcacagcgtgatattgagctggcgtggcaactgcatcagcgtggtgtaccccgacgggaaattgccgaaaagtttgggatgaagttgggcgcagtgaataactacgtttatttcgacaggagggttcaggagtgagggtgagggtttatatcgccggtccgatgacgggatatgaaaattttaaccgcgaggcatttcacaaaacggaagaggtgctgaaacgggaagggcataccgttttaaacccggcagtacttccggacgggctgactcagccacactacatggatatttgcatggcaatgctccgttgcgtggatgcggtttacatgctgaaaggctggcagcagtcggcaggtgcaggggctgagctggcactggaggagaaaccgggccatgcggtgatttttcaggaggtgggcagtgaatattgacccggcgataacgattgatatggccctgaacgccggcctggcacttcttggttatttctacattatgttctgcagcggacgatggctgtcactgttgttcatgaaaaaatggaataaacgccgtaagcaggagcaacgccagaaggcaatggatgcatttttcgaagccttcggaattgacggcatggaaccaggggatccagctcgcgcaatcagcagagggggtgtagtaatccttgtatatcggagtgaagagaaaaatgacgatcacaaaacaacgtgtagaagaaatcatatcccgcattgaaatgtatggacatggtgcagggtatatcgcagacgaggttaatgatctggctatactggcgctgaatttatcaaatatcgcgaacctgaagcgatacgagcttgatatgggaggttgcgactcgtgcggtcaggattgtggcgctgatatgactgaagatcctgatggtgattatgtcctgtttgatgacgtggttaagttgtttgaatttgatacaaccactcaaaagttagaaatcccggcaaaggaggcagccagtgggcaagattgactatcaggcactgcgtgaggcagcacaaaactatcaatcgacgctggcgtggtatcaggctaccccggacagcccaaatgctgaacgggattgtgatgcggctcttgctgcgtttaagcgtcacatccgtcatcgggaagcggatattatcgctgatttgctggatggactggaagaagcaaaatcacaactcaacgagcagcgtgagtattacgaaggcgttatctctgatgggagcaagcgtattgctgaactggaagcgcgggaagttcaattaccgactcgctacgaccttcgatatggacacccgataaatgcagatgagcgacatgtcatgatacctaaagaaaatggcagttggctttacctgattgacctagaacacgcattacgcgtcgctggcattcgcatcaaaggagagtgagatgaacggacaaatatcaattgttcgaccaggagcatgtgacgatcgcgaaatacgaatgattattcgtctggcgatggggaaaacaataactgctctcattactccagaaaatctcgcattagcattaacaggaaagtcagacatgccagtagagctaaagctgcgaaatgttgagattaaggtgaaatagctatgaccactattaccaaagatcgactgctgacaatccagcattggcgcgaaacatacggaccgggtagcaacgttgtgcttccagcagaagaagcggaagagctggcacggattgcgctggcatcactggcagcagtatcggatgaacgagcagcctatgaattatttatggagaagcgtttcggagaatctgtagatcgccgcagagcaaaaaatggcgatagagattacatggtatgggatatggcgcttggctggattatctggtgtcaccgcgccgccatgcttcaggctggaaactttcgggaaaataagggttcgtcaaccaataattttcgggaaatctcggaaacgtcaaccaactatccggtaactccggatggttggataagctgtagtgagcgaatgccggatgatggtcagcacgtaattattttatgtgatggcgcattcgttctttatgcgcaatatcgagacggtgagttttttgatgtagtccgtaatggtgatgaatttttcgaaacacagagccgcaatgtaaccgactggatgccgctaccagaaccgccgcaggaggtgcgccaatgatctggcctgaagcctttgcaattacaggcgttgctatagctattgattttttagtatatgttatttgtcggtgggggtaaaaacgttcgccgggattcacaccaaaggagggaatatgtcggatgatatttcactggcaatggaaggtgcgctggctgttattgctgttgtgggcgtttactgcctggttgtgtttttgatggatcgactagggaactgaattcattacgatatgggaattcccatatcgggtaaaaacggtttgcggtaaagcgagagttaagtagaattgctgcgggtgcttgaggctgtctgcctcgggcatgccaccgtaaggtagacagagaaaagccccagttaacattacgcgtcctgcaagacgcctaacattaatctgaggccaatttcatgctagacacatgtaggttagcctcttacgcgccgaaaggcaaggagaagcaggctatgaagcagcaaaaggcgatgttaatcgccctgatcgtcatctgtatcaccgtcatagtgacggcactggtaacgaggaaagacctctgcgaggtacgaatccgaaccggccagacggaggtcgctgtcttcacagcttacgaacctgaggagtaagagacctggcgggggagaaatccctcgccacctctgatgaatcaggcatcctcaacgcacccgcacttaacccgcttcggcgggttttgttttttcctggcattctggtttacaattcgcacgccagcctgaacaactggcacctgctgcgccagcagagacaaccgatggcgcacgataccaaattatacaattctgatgattctgccgtctttgccagcaggcgcggacggtgttttcacgcattcaaatctgactggtaccagcatcccccatgcactgaagaacaggccgaatggctcattcagtgttaccgcaggcgcggatgcgaggttaaaaaagcccttagcctcgactaccgtcactggataatctccgtcaggctcccttactccgaacggccaccgcgtccgtcccgcacattccagcaacggatctggaggtaatgtgcgggtattacttcgacctgttctggtaccggaactcggtctggttatcgttaagccaggccgtgaatcaatgtcagcattccataacggcagaatactggtggagccggaaccaaaaagcatgcgagctctgccgtccggggttgtacctgccgttcaccagccgctggcggaagataaatcactactgccatttttcagcgatgagcgggtgatccgtgctgcgggtggcgctggtgcactgtctgactggttattacgtcacgtgaaatcctgccagtggctacacggtgattatcatcatagcgaaaccgtcattcaccgttacggtaccggcgcgatggtgttgtgctggcactgcgacaaccagctgcgggagcagacatctgattcactggatcaacttgctcaacagaatctggccgcctggatgattgacatcatccgtcacgcaatgaatggcgcacaggagcgtgaattatctctggctgaattatcctggtgggcggtccgcaatcaggtggcggacgcgctaccggaagcggtattacgtcgttcgctggggttgcgtgcggaaaaaatccgctccgtataccgtgaaagcgacatcataccgggagaacagaccgccaccagcatactgaagcagcgcacaaaaaatattgcgctaccgtctcacacccaccagcaacagaacccaccacaggaaaagacggtggtcagcattgccgttgatccggagtctccggaatccttcaggaaacgacctaaacgtcgccgctgggtaaatgagaaatacacacgctgggtaaagacacagccgtgtgcgtgttgtggtaagccagcggacgatcctcatcatctgattggtcatggtcagggcggaatgggaacaaaatcccacgatattttcacgctaccgctgtgtcgggagcatcacaacgagcttcatgcggatccgctggcgttcgaagaaaagcatggttcccaggttgatttaatttttcgttttcttgatcacgcctttgcaaccggcgtgctcgggtaaaagaggttactgatgcgtatagagtttgttttgctttacccgccgacggtgaacacctactggcgacgtcgtggcagcacatattttgtatcaaaagccggtgagcgttatcgccgggctgtggcgcttattgttcgccagcagcggctgaaattaagcctgtccggaaggctggcgataaagattattgccgagccaccggataagcgccgccgtgacttggacaatattctgaaagcgccgctggatgcgctgacgcatgcggggttgctaatggacgatgagcagtttgatgaaatcaatatcgttcgtgctcagccagtatctggtggacgtctgggggtgaagatttaccccataatgcttgaagggcaggtcaaaaaatgaaactggaagatttaccgaaatactactccccaaaatcccccggcctgactgatgcatcggcctcaacgtcgaaagatacgctgagtatcactgatgtgatggccgcgcagggcatgacacagaattgggctgagatggggttttctgcgttccttgggaaaatgggcattagtatgaatgacagagagcgggcaacagaattgctgacagaatatgcactcagtcggtgtgatcgcgtggcggcgttaagaaaactcccggcagaaataaaaccggcagtgatgcgtattatggcttcgtatgcgtttgaagattatgcccgtagcgcggcgagcaaaaaacagtgcccctgttgtcacggaaaaaaatttattgaaagcgaggtttttacaaacaagatccagtatccggatggtaagccgccagtgtgggcaaagtgcacaaaaggcgtgtatccgtcttactgggaggaatggaaaaaagtcagggaggtggtaaaagttgcctgtccggagtgtggagggaagggggaggtttccaccgcctgtaaagattttcgtgggcgcggtgttgccattcatcgtgaagagtcggtaaaacgtggtatgcctgttatcagagactgccagcgttgtggtggtcgtggctatgaaagattaccttcaacggaggcatttaatgccatatgtaatgtaaccgatgccatatctcttgatacatggaaaaaaacagttaaacgtttttacgatacgctggtggtgcagtttgatattgaagaagcatgggcagaacaacaactgaaaaaggtgaccagatagctttgttgatttttcccgaatctgtggtaaatttgccctaacgatgggcgttttatgcctgacgttagaagattttttacacccgtcgccaggcgggtttttttatgactgaaatcacgccagtacagtaaacgcgctggtggttgtgaataccggtctttctgcttgctggctttttcgacaagagttattggtgtgtcacgttaaccggaaaaaggaaagtttgagaaacgcgatctggcacaggcggtgattaacgccgcatacctggtggcctgtgcagatggtgaatgtgaggcttcctagaaagcgaagatcgaacaggtactgcgtaatcagccagcgctgtccgcgtttacgtcagaaattaatgcgattagcgcaaccattatcggtcagctggatacgaactttaaaactggtcgtcgtgcggcgttacgtgagatcgaggatgtgaaacacgatacgcgtgaagcggaagatgtgctggatgtggcggtggccattgcggaggcagacggcgaaattgagccggaagagcgcaaggtgctggaagagattgccggtgttctgggtcttcgtctggagaattacctgtgacggtaaaactgcgtctggctgtggctgcactcctgctgtttctggtggtgatggtggatttcaccagcagaatcatgtcggtgctggcggatggggggctggtctgcggcattgtggtattgctgtggccggtgataaaaagaaacagcctgcataatgcttgatttttttgtttactgtttattaaaaatactactgcatggcgaatccccctgtgcggaggggcaatcagcaaccaggtatatgggataatcgcggattcaggtgctggtactgaattcaccgggaggcacccggcaccatgctttgccacaaaagtgttatttctgtttttctcaaactatcatcgttatccctttatttccggctgcgcatggcgcggccttttttttacgaccagccactggcagatggtcatcctgtgatttgattccggttccggctttttaactctgttcctgtacacgggagaaattcgatgtcgattaaacattatgatgttgtcagggcggcgtcgccgtcagatcttgcggaaaagctgacacacaaactgaaagagggctggcagccgtttggtagtcctgtggccataaccccttataccctgatgcaggcgattgccgcggagggggatgtgaccacgccagtggttgtgcccggcacgggggatggtggctatccgggagtggtcaccacggagccagattattactacgttattccactggccgggcagtcgaacggcatggcttacggtgaggggcttcctctgccgcagacatatgaccgtcctgacccgcgtataaagcaactggctcgtcgcagcacagtgacgccggatggcgctccctgtaaatataacgacattattccggcagaccactgtctgcatgatgtacaggacatgagccgtcttaaccatccgaaagctgacctgtcgaaaggtcagtacggaaccgtggggcaggggctgcatattgccaaaaagctgctgccgtttataccggcgaatgcgggtattcttctggttccgtgctgccgtggtggttcagctttcaccaccggggcagatggaacatacagtgacgtgaccggtgcctcagagagttctacccgctggggtgtgggcaggccgctgtataaggatctcatcggtcgtacaaaagccgcgctggcaaagaacccgaaaaatgtgctgcttgccgtggtgtggatgcagggggaatttgactttgacggaacgccagcaaatcacacagcccgttttacagaagtagtggaacaatatcgtacggaccttgcagatatggtgggacagtgcgctggtggttctgctgacggtgttccctggatatgtggagacacaacttatttctggaagcagaagagcgaatccacttaccagacggtgtacggcagttacaaaaacaaaacggaaaagaatattcactttgtgccgttcatgaccgatgagaacggagcaaatgtcccgacgaacaaaccggaagaagacccggatattccggcatcaggatattacggtgcggcctcccggacgtcggcaaactggacgtcagcagaccgtgcgagccatttcagctcatgggcacgcagggggattatttctgaccgtcttgcctcagcgattcttctccatgcaggacggacggctgaactggtgggtggggaacaggttgtgatgccgccggatgagaagccgtcaccggacacaccatcaacaccgtcaacggacgggaaatcagtgacaacgctgctttattaccgtgcaacagagtcaggtggtttactgaatccgcagggatggggagctgaaggagggcgtgcattggtagttgatgatgcaggtgctgcaggaggtaaggcgctgaggtggaccaaacagacaggaagttcctcgtggtttatgcagcatgatgccggtaatggcgcagacctgctggagaagggcgggcttatcagttgtcgttttaaagttgatggcacactgacagctaatcagtacgcactggcgctgtactggccggtttcttcactgcctcagggcgtcacactggaaggtaatgccggtcataacctgctggcgtcgttttacgtacagagcgatgccacagaccttaatgtgatgtaccacaagggaaatgctggtcagaacacgaagctggggtcattcggcgcatttgataacgaatggcatacgctgggcttccgttttgccggtaacaacagtattgaggtgacgccggtcattgatggtaaggacgggacgccgttcatgctgtcacagtcaccggtcggcacgtttacggcagacaaattgcgcgtgaccgatatcactagcggtgcgacatatccggtgctgattgaaagtataacagtggaagtgaataacccgtaagcaggaaaaaaaggccgccggggcagggaaaacaaggagccagaaccggcggcaaatgtcgttatatccaaagcaaaacatgcaggacacttttttaaccaacaggtattaacgatgtcaacaccatatcaataaccgggagggataatgagatttgtacagcttattttattgtatttctgcacggtggtgtgcacgttatatntggtaagtggcgggtataaggttatccggaactatatacgcaaaaagattgatgccgcggcggcggaaaaaatcagcgccagccagtcagccggaacaaaacccgaagagcctctcatttcgtagcaactttcttaacaacacctttcaacgagaaaatcccatgtcagaaataaaatctctggtcactgctgaagcagtgaaggacgtcctgcgctctgaagaagtcagaagcgcactgaaacagcaactccgccagaatcttgaggcgcgtcttgatgctgaagtggatgccattctggatgagctgctggggggaccggctgctcctgagcctgaagacggcgcgggtgacagtgctgtttcagatggcgttgtgtctcagcctgacggtagcagtgagcctcagcctggcggcgaaatgatgatgtaaccatacgcaggggctgtcggtgtgagctgatgcccctcctgttgttgtgagcttccggattgcgggagacggggtatgtaccagatggaaaaaatcacaacgggtgtgtcatacaccacgtcagcggtggggacgggatactggttactgcagctgctggacaaagtctctccgtcccagtgggtggcgataggtgtgctggggagtctgctgtttggcctgctgacgtatctgactaacctgtatttcaaaatcagagaggaccggcgtaaggcggcgcggggagagtaaagcgatgaagaaaaaatacgaactggttgttaaagggataaataattacccggataagattactgttactgtggcaccggaaattggtgggtatccgtcactgttgttgccagatgtggcgattagtcttgaccgtactgaaggtgccacgctggagttttacgaagctgaggcgaaaaagcaggcgaagcagtttttcatggatgttgctgccgggttatgtgaaggggatggtccgttgccggaaaagcgccccgtaattttagaggcgcaggatgtgttgataacctacagaggaaaactaccgggaataattacgggttctctgaagactccaccgctggcctgaagacttaacatatccagggatttgaaatcgataaaccctgataaatatccatgaacgcaaaaatcagatacggcctgtcggctgccgttctggcgctgattggtgcaggggcgtctgcgcctgaaatcctcgaccagtttctggatgaaaaggaaggtaaccacaccacagcataccgtgatggtgcgggtatctggaccatctgccgtggagccacccgggtggatggtaagcctgttattcctggcatgaagctgtcgaaggaaaaatgcgaccgggttaacgccattgagcgtgataaggcgctggcatgggtggagaaaaacatcagagtgccactgaccgaaccccagaaagcggggattgcgtcattctgtccgtacaacattggccccggtaagtgtttcccgtcgacgttttacagacggattaatgcaggagatcgaaaaggtgcctgcgaagcgattngctggtggattaaggacggtggcagggactgccgtattcgctcaaacaactgttacggtcaggtatcccgtcgtgaccaggagagcgcgctggcgtgctggggaatcgacagataagcagaatattttgctgaaaaatgaggtttgcttacatggacggataacacgaaatcctgcaaattggcaaaatgtaagtgaataaagtcaaaacagttgtttaacactcaggcaccgtaatgatgcctttgtcatttctgcgcatctcacgcgcatctcacaacacagaacctttcaggatgacccttgaggataccggtttggctgtcggtgcctttctgtgggctggattcctgtgagacaaggttcatcactaaaaggaaataaccgatgaatatgatggccgtgccgtttcacggcaactctctttatgtagttaaccataatggcgaaccatacgttcccatgaaacctgtcgttgcggggatggggctggcctggcaatcacagttggctaagttaagacagcgttttgcgtcaactataacggaaatcgttatggttgctgaggatgggaaacaacgcaatatggtgtccatgccacttcgaaaacttgccggctggctacaaaccattaatcccaacaaagtaaaacccgaaatccgcgataaggtcatccggtatcaggaagagtgcgacgatgttctttacgagtactggacgaagggttttgtcgttaatccccgtaaaatgagcgtgatggaagaactcaaccaggcttgtgctgacatgaaacgggataaaaacattgccagtgtgtttgctaccgggctgaatgagtggaaacaggttaaagccgcgcatgtatcaaaaatccgtacgctggtaaatgaagcgaatatgctgattgattttgtcctggctgatacaggcaaagggaaaataacaaaggcggattgatggggtggctaatgatatcagataaactcataacgctggtgaagagcctctgtgtacttgtcggcatttcatttttagtcatgctggttgccattttcttttccaccgcctggcgagtcctgacgttatcgggactggtggggtgaaagagagatgaaccgtgttctgtgtgtggtgattattgtcctggcggttggctatggtgcgctgtggctggcaacaaaccattaccgtgacaacgcgctcacctacaaagcgcagcgcgataaaaaagccagagagctggaacaggcgaatgccaccattactgacatgcaggtgcgccagcgtgatgttgctgcgctcgatgcaaaatactcgagggagttagccgatgcgagagctgaaaatgaaactctgcgtgctgatgttgccgctggtcgtaagcgcctgcggatcaacgccacctgctccggtaccgtgcgtgaagccaccggcacctccggcgtggataatgcaaccggcccccgactggcagacaccgctgaacgggattatttcatcctcagagaacggttgatgacaatgcagaagcagctggaaggggcacaggactatatccgcactcagtgcctgaactaagttttgctgatgcgccgtatcgtcgccgtattcctgcattaacagagaccgcagcccgacagggagactcctctgcgagagtgtgcggggataatcaaaaacgatacacaccggggtttaccgcgtaaacggagcgcggcgttctcccctcatggtcgcccgtccggtgcgatggtggaagaaactggaatctgttcaataaaaaaactgccgtgttggagtcacagcagtaatgtactgattgggtagaagattattattgttatgctttatttttattctatatggctgattatttcaattcggaattaatacagctaatgtctgtgagtttttataaattcagcaatataaagaaatagttatatgaacagccatcgcagagcatactgtgtatcattcttttttatagtcaactgacgggcatattttatgtctgctgccagctcccggcggcaagattcaatgacccacgcagaaaaattttctgaacctttctggtcaagagcgatgttaatttgttcaatcatctggtttggaaatcggatgttgcgggttgttgttctgcggggccggtttttcgatgacattttctttcctctggtgacaagctatatggcgaggattttacatggctgtgcttcgtacgttaccgggcagaatcaaaactctgaacacccggcggataaatgtcctgaggggggaacagcgtcgtgtcagtggcagtgcccgggtttccctcaaacgtcgtatctggcggagggatgccggacactgttgtctctgtagacgcgtggttgacctttgtgacagtgaactcgatcaccgcattgcacttcagttcggtggtggtaatgaggagacgaacctctggaccctctgtactgaatgccatcgccagaagtcagcgagtgaagcggcgagtggtatgcctgatccgacgttgcctgagcttcctgatggcacgctcagggccgacggaatcactggcctgtgaccagacccgggggggatcatccggcgaaaaaaaacgatcgccctggacaccgcgccccctctcacgcagagaaaaaattcccgtttcagggcagttaacatgttaactggctgcccgggcatttttgcggtttttatctttattattcagtttgttgtgcggaaaaaatgttaacaggctttttcagcaaatgttaaccaggcagcagttaacatttgcggcatgagacgccgggaaaaatgggctgaaccatacccggctgagtgcgttctggacccgggaggaggctgtgctgacaacgcaaaaacgaaaatttgcgctggcgctcatgtccgggaaaaacaaaacagcgtcagcccttgccgccggttattcggcgaagacagccagggttaaaggctcgcagctggcaaaagatccggaggtgcttgcgtttatagcccgtaaacagtgcgagacggtggaggtggatgaggttcctgtttatcggcagaaaaaatcagagccggaggataaaccccgtcgccgtgaggcggctgcaataccacagccggacgaaacaaatccggagatgccaccgcccgtggtgatatctcctggtattgagtatatggaggacggtcttcccgatccggtgaaagcgatggggcgtcttctggtggagaacattaataccgaccccaggctggcgctggatgcggcttataagctggcgcagttcacgcaccacaaaaaaggggatgccggtaaaaaatcggcaaaaggtgacgcggcgaaaaaagcggctaaccgttttgcggtgccaccaccaccccgcctggtggtgaataatgataatgagggcaacggatgatacctgtgtggagcacggcctgcccggactgggcagagcgcctgaaaaaggggctgtcgattattccggctccgatttatccggagcaggccgcacatgccctggcgatttttaaacaactgcggattgtggatgcaccgggcagcccgacgttcggggagtcctgcgcacagtgggtgtttgacctggtggcggccctgtttggctcctacgatgcgcagaccggtgtacgccatatcaaggaagtttttatccttatccccaagaaaaacagcaagtccacgctggctgccgggatcatgatgacggcgctgttactgaactggcggcaggcggcgggctacaccattctggccccgaccgtggaggtggcggctaacgccttcaaccctgccagggatatggtacgacgggacgatgatctggatgacctctgtcaggtgcagacacatatccggaccatcacccacagggtgacggacaccaccctgaaggtggtggctgccgatccgaatacggtatccggtatcaagtccgtggggacgctgattgatgaactgtggttatttggcaagcagtacaaagcggaggacatgttacgtgaagccataggcggccttgcctcccgcccggaagggtttgtggtgtatacgaccacccagtcgaatgagccgccagccggggtgttcagacagaaactgcagtacgcccgggatgtccgtgacggcaaaattcatgatccgcactttctgccggtgatttttgagcatcctcctgaaatggtggaaagcggggctcacctgctgatggaaaacctcgccatggttaacccgaatctcggttattcggtggatgaggcttttctgtaccgggagtaccgtaaagcccgggaggctggtgaggaagcatttcgtggcttcatgtcaaaacatgccaatgtggaaattggtcttgccctgcgttctgaccgctgggcgggtgcggatttctgggagcagcagggcaggcgcgtcagcctggacgatatcctgcagcgcgctgatgtggtgacggtggggattgacggcgggggcctggatgatctgctgggaatgtacgtgattggccgtgacagggaaacccgcgaatggctgggctggggccatgcctgggcgcatgaaaccgcggtggtccgacggaagagcgaggcgtcccggtttcaggatcttgttgcctgtggagatatgaccattgtccggcgtgtcggggatgacacggcggaagtggcggaatatgtgcgtcgcattcatgaggctgagttactggaccatatcggtattgacccgtcaggggtggggcagattctggattcactggcggaagccgggatccccgacggaattgtggtggggataagccagggctggaaactgggcggggccattaaaaccaccgagcgcaaactggctgaaggggtgctggtgcatggtgaccagcccctgatggcctggtgtgtcggcaatgcccgggtggagcctaaaggtaacgccattcttatcaccaaacaggccagtggacggggaaaaattgacccgctgatggcgctgttcaatgcggtctccctgatgtcccttaacccggaaccgaaaaagaaagaatatgcggtttttttcatataaccctgttcacactgtaaccatcatgaaccgctgcggcggtttttttattttcaggaggctgatgtgactcttaaacgggcctgttccctgctgacggtgaaatccttcagtgaggatgaacgggtgatcaccgggattgcgtcaacgccttctccggatcgggatggtgacatcctggagccggagggcgcggagtttggcagtgcgatcccgtttctctggcagcatgaccattcccgcccggtggggcagtgtacggtgcgccgggtcagcgaagggctggaaatcacggcaacactggtgaagcccgtaccggatatgccgtcgcaactggctgcccggctggatgaggtctgggcggccattaagaccgggctggtcagggggctgtccgtgggcttccgtccccatgaatacacctttctggacggaggcggactgcattttctgcgctgggaactgatggaggtgtctgccgtcaccgtgcccgcgaatgcggaatgcaccatccggaccattaaatcttacgaccgcccgttttctgccgcgtccggcaaccggaaaccggtggtgaaaatcgcatcttctgccggcgctgcggcacagtcaacaaccgtttttcataaggaaaagaccataatgaatattggcgaacagattaaaagttttgaaaacaagcgtgcagcgctggcagcctcccttgaggaggtcatgaccaaagccgcagaggaagggcgcacgctggatgtggaggaggaagagcattacgacaacaccgcagcggaaatccgtcaggtggatgcgcacctgaagcgcctgcgtgaactggaagccggtaaggccgccacggcgcagccggtgaaacaggccggtaacgggaatgtggccgcggtggcttctgcgccggtgatccgtgtggagcagaaactggataaggggattggcttcgcccgctttgccaaatcgctggctgcggctaaaggcgtccgatctgaagccctggaagtggcccgtcgtcagtatccggatgacagtcgtctgcatcatgtcctgaaatcggcagtgggcgcggggaccaccacggatccgcagtgggcaggcagcctgtctgaatatcaggaatacgcacaggactttattgattacctgcgtccgcagaccattatcgggcgatttggtcagggcgggatccctgcacttcgtcaggtgccattcaatatccgtgtgcacgcccaggtgtccggcggtgctgccggctgggtgggtgagggtaaggcaaaacccctgacgaagtttgattttgaatccatcaccttcagtcatgcgaaggtgtcggccattgcggtactgacggaagaattgatccgtttttccagtccggctgctgatgcactggtccgtaatgcgctggcggaagcggtggtggcgcgtctggatacagactttgtggacccgaaaaaagccgcagtggcagatgtctccccggcgtccatcacccatgatgtgaagggcacggcatcaaccggtaacccggatgcggatgccgaggctgcgtttggacagtttgtggcagcaaacctgcagcccaccggtgcggtctggctgatgtccagcaccaatgccctggcactgtccatgcgtaaaaatgcgctgggtcagaaggaatacccggacatgaccctgctgggtggctccttccaggggctgccggtgattgtctcccagtacgtgggtgaccagctggtgctggtgaatgccccggatatttatctggcggatgacggcggcgtggcagtggatatgtcccgcgaggcatcactggaaatgcagtctgagccgggcggcgacagtaccacgccgtccccggtggagctggtttccatgttccagacaggcagcgtggccatccgtgcggagcgctggatcaactggcgtcgtcgccgtactgcggcggtggcggtgatcaccggagtgaactacggcagtgcgtccggcggctgagtctgataaggaggacgggaggcgtgcgcctcccgtaacaggttatggcaaagatccgatatctgcagggcacgcatgatgcccgggccggggatatccgtgatgtggcacagccgtgtgcggaggtgctggttcgcctggggaaggcggagtacatcacagcgcgacgtccggcaggtcagaaaaagaaacgtgatgcggagcatggcgaatgtggaaccttttgcggcgaacccgaaaaaaccagaaatcaggacgtgacgtaagagaagtgggctggcggtccctgtttcaggcggtggctgagccttttgccggtgcctggcagcagggggtgaaagccgatccggaaaccgttttgtcctttcacgcggtgttttcatgcatttcgctgatatcccaggatattgccaaaatgcggcttcgcctgatgcagactgatgtacagggaatacgccgggaaaagcggcagggagatactgcccgtctctgtcgtcgtcctaatgcgcagcagaatcgcatccagttttttgaactgtggctgaattccaaattgcgtcacggcaatacggtggtgctgaaaatccgcaccccccgggggcagatcaaagaactgcgtattctggactggaaccgggttgaacctctggtggcggatgacggcgaggtgttctaccgcatcacgccggaccggaactgtgggatcacagagtcggtgacggtgcctgcccgggaggtgatccacgaccgttttaactgtttttttcatccgcttgtggggctgccgccggtgtatgccgcaggactggccgccatgcaggggcatcatattcaggcaaattcgacgtattttttcagaaatggcgggcgaccatcaggcgtgattgaggtccccggcagtattacggaagaaaacgcgaaaaaactgaaggggaactgggacagcggatatacgggcgaaaatgccgggaagacggccatactgagcaacggggcaaaatacagccccacgacgttttcaccggtggatgcgcagacggtggaacaactgaaaatgacggctgaaattgtctgttcggtgttccgtgtcccggcctacaagattggcgttggccacccgccttccagtgacaacgtggaggcgctggagcagcagtattattcccagtgtctgcagacgctgattgagtccattgaactgttactggatgaggcgctggaaacgggggaaaacgagagtacagaatttgatgtcaccacgctgctgagaatggacagtgagcggcgcatgaaaacgctgggggatgcggtgaaaaatacgcttctcacgcccaatgaggcccgtaaacgggagaacctgccgcccctggccggcggtgatgcactgtatcttcagcagcagaactacagtctggaggcgctgtcccgtcgtgatgcccgtgaggatccgttcgcgtctgccgggaaaacagtttcatcacagctgcctgacggcgcatctgacggtaataaggcaatcagtgaaacagagcatgatgcggtgaaagcgatgttcaggggggatactgagaaaatgacggaacgggaactgtccattattcgtgcactgggagaagaattttccacagtgctggcggatttacagcgcacatttgaggagaaaatagccgcgcaggcacaaacgtttgaagaaaaactggcttctcagtctgtggtattacagaagtgcgtgacgggtgatgatgtgcgtccgatgcttgagcagatggtgaaagaggca

SEQ ID NO: 70 - DNA  (genomic), 3191 bp; double-stranded, linear
ctgtctgcgaagcagcgcccatacccgacgataaccatacgtgggcagctctccgataacatggtgtatacggagaagcacatccnccttntgncagtgacgactgcggcggccatccatccagtcatcggttcgtctgagaatgacgtacaactgcgcacgcgacacccggagacaacggctgactaagcttactccccatccccgggcaataagggcgcgtgcgctatccacttttttgcccgtccatattcaacggcttctttgaggagttcattttccatcgttttcttgccgagcaggcgctggagttctttaatctgcttcatggcggcagcaagttcagaggcaggaacaacctgttctccggcggcgacagcagtaagacttccttcctagtattgcttacgccagagaaataactggctggctgctacaccatgttgccgggcaacgagggagaccgtcatccccggttcaaagctctgctgaacaattgcgatcttttcctgtgtggtacgccgtctgcgtttctccggccctaagacatcaatcatctgttctccaatgactagtctaaaaactagtattaagactatcacttatttaagtgatactggttgtctggagattcagggggccagtctagtcatntacacaaccaacgccatcgagtcgctgaacagcgtaatccggcatgccatcaaaaaacgcaaggtgttcccgacggatgactcagtgaaaaaggtcgtgtggctggcaatccaggcggcttcacagaaatggacgatgccactgcgggactggcgtatggcaatgagccgctttattatcgagttcggtgaccgcctggacggtcacttctgagaaaaggcatttacacagaatcgtgtacagggtcaaatattttaattttactacattgcatgattacaatcatttttgtgactttattgagtttaaacacaaaaatattattatgaacacaagtcagtacacaggaagttcatggtaaaaccacctcctgtggaggtggttgcttgcagtcaggtgtttcgggtctgtggctttttgtgttctctggtaagtggttgctattcttttgtgttgtgtatctctgtttctatagttttagatagccatgtcatctcagtaactgagagttttagttttggggttctttctcctgcgccgggtgggcgcatgtcaaaactacaggcttttttttggtacactgtatagctatctacattacatgttgttgatgtaagtatgcagttctttgacgctggcttgtcttttatgggaccggatatttccgggtaatgtacttgtgaacttgaaaatctgtttttgattgaaaatggcattgttttctcctttgctccatgaaaagtgtttttatgctattccgttataagttggtatcattaagaatatttatatgtggaaccagagtattttggacgatagtctttccattctggtgtatctaatattctttctgctggtatctctttgccatgtagataaaattttatgtttttcattatttggttgttgtctttattacggtaaatccatcgtaattcgctggcggtaatactctggccatagccctctgacttgttagctatgagtttgagtgagttgacaagctcatccgcacaaaaaataaccgttttattgcgtgttaatgtctgaaactctaggccggccttgcttgtttttgcccataatttgtcgcgattgtatacggaaaggtcggccatggtaacattataattattgtgaatctttaagtgttgtttaaattttattcctctttcgtgttcatttaatgctcttttgataagtggatcttgcttatatttgcgaggtgttctggggtcccatactgcgtttgttaacgtattctgagttataatatcttttttggaaaagtcgttaactagtttaatgctgttgacaagtttttctctgggtgaagatagtccatagacaatgtctccctcgcgaaagtgtaaggccacatccagagcgttgccctgaaaggtgatgttttttgctttaactacatctggagagagtagtacattttgtaaatcaagatccagcccatcaggcatcccttcaacaccgatgttccacgtggttttctgctccgcatgaatggttaccgatgtcacactctccggaagtttctccggcagtataatattgctacatccagtcagcgatagcgtcttcagtgacggtgatatcaggttgtcaattctggcctgattctccgggttatagctattgatgctgagagatgataacccgtttggaacattttttatgctgtctgtggcgctaccttttatttcaaggtagcggacactctctggcactccagatatatagcagtggcaaaccgtcaggcactcgatgccttcagatatgaaatgtataaatggtgaatcagttaattcaatatgtagattttttacggttgatggcatgtctgtgatttgtaatttttcacagttaatgacggagaggttttgtgtattaaccggcaatcctgtaagggttgtcaggttgttgcagttttcgattgtaactgatgttatttcgtttggtaactgtggcagatactcaatatcacaatctttgatatataaacgaccactggcccgcgcttcttctatctgaattggtgtgatttcgcttttgatgtctgctgatgtttcagcggaataggagcagaatgtcccggtcggtcgtaattgcgatgtaggaagcattgataaattccatttttagaaataaataacagagtaagttctatccatactactaatcaacaagctaattttaacaaccagcaaagccaaggtgtcaatattagaaaagagagttatatctcaaaaccaacagactgttgattttaacttttgcgaatactttctccagtccgtcatgcatggattaggattgctcatttttataccatttgttgtttttttatagcgatttgctaaaagggagaagaaaaaacgttctccaaaattagattgcaactgtttgattttatggatagaggcatgctgtttactagacagtaaaaagcatgccaaatttcctattaaccttttgaatataaagcactaattatctatttctgttgccttcttattcagcag

SEQ ID NO: 71 - DNA  (genomic), 15472 bp; double-stranded, linear
attagtgttttttgccgtttcataatgtttcagattgttcattatgtttttgattataaacagatttgtgattttccttgttccagcttgtttcacgttgtagccctttgtgcaacgatcggtgtagttaatggtgtagttaattgtgatgaccggaatcaaaattatgagcagagcacttaacaaactgagcgatacacagctgaggaaaatcaacggcacacccgcccaaaaaacagcctttcttaatgacggtggaaacctgagcgtcaggcattcaaccagtggccttttaacctggtatttcacttacagggccggaacgggaaggggggcaccaccggaacgcattaagctgggaaattatcctgatctgagcctgaaatcagccagggaaaaagccgcccagtgtcgcgcatggctggcagaggggaaaaatccacgtcatgagcttaattacaccgtacaggaagcgttaaagccggtaacggttggcgatgcgctcacctactggcttgagtcgtacgcaaaggaaaaccgcgtggattatgccgccctgaaaaagcgccttaataatcacgtaatacagcacattggtgctatgccgctggataaatgcgagctacggcactggctggcctgttttgaccaggtggcaaagcgaacgcctgttactgccggattcttgctacagacgtgcaaacaggcgcttaagttctgccggaggcggcgctatgcaatcagcaacgttcttgatgatatgagtgtggcggacgttgggaaaaaaccggatataagcgagcgtgtcttaagcaccaaagaactgggcgaattattgcaggcactggacaaaaaaatattctccccctactacatcgcgttaatccgcctcctgattgtgttcggatgccggacggtagaactgaggttatcggagatcagcgagtgggattttaccgaaatgctctggaccgtgccgaaagaacacagcaaaacgaaggtggcaatattccggcccataccggaagcaatactgccgttcgtcacgcagctggtggagcagaacaggcacacgggtttattgctgggggaagtgaaacaggaaacaagcgtgtcgcagtacggcagattagcgcataggaggctaaatcaccctcactggtcactacatgacatccggcgcacctttacaacgatgctgaacgatttaggcgtggatcctcacgtcgtggagcagcttacaggccaccagatgccaggaatgcagcgagtttataatcattcccgttatctggatgctaaacgcaatgcgctggatatgtggacggagcggttagggatactggcgggaacacatgaaaacgtaaccacgctaccagtagccagaagaaaataatttttttcgtgttttttcagcatgcgcatactggatatgcgaacagatacaacgtgcagcaatgagcaacaatgtggaacaaccacgaacaagaggcgaaaaagcgtacggatttataagtagctgatttttaatgtgttactggttttttatacactagcgaatcactctttaaagagcgagaaaaaaggcatgaaacaatattttatgcctttgtattaacatgaatttaaaagattttattcttactgtttcattttctgtaaatcatacatcctcagtatttgccattcatcactctagcgggaacaatacgacacaataagacacctgatgactctttaagaaacgaaagggggcaatagtgttaagcactgatcggtttatacgtgaaaaagaatgcgaaaaactaaccggccttagccgtacgtgtcgctaccgcctggaaaaggccggacaattcccatcacgtcgtaaacttggcggtcgttccgttggctggtctttatccgaggttctggcctggaaggatagctgcaaggcagttcattaatcacgctggcggcacgcagccgccacacatcaatcatctgaacacagagctataaccatgaagattgaatatacgccagaacgtgggcggggattcgttcgccctggtgaaactgaaaaacaacaaaattggggtttttcaggtataaaaaaagcggccccgaaatggagccgcctttctgaacagataacccgctgcgccgtttgtgtgtgtgatcccaaacataagcacggggatgatagccgctatcaggctggtgggcaatgcaatcagtctggttcagttcgttgccatacctgcaatgagcgcttttccctgtactctttaaggaattgctcaagggcaaaagcacatggtgcgaatctttctgattcatgctctatctttctgcgccgtcttttccgtgccggtgataatgttttggtcaattctttatcggtcattgtgttgtcctgcatagcaatgcgccgtaatacctcacaccacggcgctgatagtttttatcctttgggttctataccgcgccgctttagttcagtacgccccaactctttaagccagttggctaggcttatgccgtcgctctgtgcttctttatcgaattgctcttttagctctggagaaattcgcattctgaattgtggggattgcccgtcccctttagggcttttatcgcgtttgattgttgacaagtggtcacctattgaattagcctttctattgttaggtggtcaccttaacacaagagcacttaaaaaagcaaagccccgcaagtgtcattaccactcgcagggcttctaaccaacaacgtaaactaggagccgttatggttgctgtaaatcatataccacaccttgtacacacacaaacggcctttgtgtggcgttttctggcactgagtgccggagaatctcaaatcatccacgtaaccgcctggacggaacgcgaagcgcgtagccgttgcccgtcaggttgtgttgctgtatttgccgcccgtattcgtcagggggtgtgccatgcttaaaaccttccgtgtatttgccagcgctgttaacccactaggccacacaattggtatcgctcagaatgtgaaggctgttaatgttcagacggctattgctgcggtgagaagcgaatcatcagaatatggcttatcacaagtcattatttcagcagtgtatgaattaaaagaggtgcattaatgaaggaaattacattacacgaagccgctgaacgtgcgcaccagacagaaattatttgccgccttcttgaggtataccctgataaattaaatgatggtgatatatccgcattagctggccttctggcaaaactgtcaggaagtgttgcgctgtggttaattgatgagagagccgaacgctatgaaaaataataaactggcgaccagtgaattaagaagccttgccaacagcgcaatatctttaaacaacgcagcaaacgaagtaatgaatatgtggcttcagtcgctggtgaataatgaacgcgatgaatcaactgcaagattaatattagccgtttctgaattactggatagttcaaccagcaaaatagagagcatatcagagaagattaacggcttatcaggtcacgctatcggggaataaaaataatgaaacttaaatatcctggcttaactgacagcggcaaaactcgcactaaattcatgcgcggggatatttaccgcgaccagtacggcggcacggtaatgattaagggcgtggaggaacggcgcgtaacctaccatcgtgaaggctacgaatatgattgcgtgatgcctgtttatcagttccggcgtgatttttctctggtacaggcagcgccccgcagtaaaccaaccagcagggagaaagcacgcgccaatattcaggaaataaaaaagatgcttaacgtattcaggggtaaaaaatgaaactggcaccgaacgtaaaaaaacagccacgcggaataaaacacaaagacacagaggtgattattttcgcgggtagtgatgcgtgggcacatgcaaaacagtggcaggagcaggacggccccgcatccggcgataatgtgcctcctgtgtggcttggggagcagcagttatcagaactggataagctgcaaattgtgccggaaggcagaaaatccgtgcgcatattcagggccggacatcttgcaccagtaatgatcaaggcgattggtcaaaagctggcggcggctggtgtacaggatgcaaatttttatcctgagggtatgcacggtcagaaggtggagaactggcgcgaatatctggcccgtgagcggcagaatctttctgatggtctggttattgagtttccggtaaagaaaaaagataccggaagccatagcgatgacgaattaaagccacgcgttgaaagtcgcgccgatggtgttttctgggtaacgcccaaagtggataagcagtcaggcgaaattatccggcctgagacgtggttatgttctccgcttgaactactgggaacggggacgatcggtaaagagcattaccgcgtgatgcgctggaaaaaaaccgcaaaccatgaagtcatcacaatggcgatcccgtgtggtggtatcggcgaccgtgacggctggcggttacttaaagatcacgggctgaacgtgacaaccaacggcaaatacagggcaatcctggcggactggatgcagttaagcggaagccatgaggaatggcagttaagcacaacaacgggctggcattttggcgcgtacatcatgccggacggttcgatcattggtgaatctgaaaaaccgatcctgtttaccggaaaaagcgccgcgattaacggttattccgtggcgggcacggcggatggctggcgcgacagcgtggcgcggctggctggcggtaatgcctcaatgatactgggtgtggcaacgtcactggcagcgcctttaattggccttgtgggtgctgacggcttcggggtgcatcttttcgaacagtcatcggcaggtaagaccaccacgcagaacatcgcatcaagtttatggggagagccggacgcgcagcggctgacctggtacggcacggcgttaggtattgccaatgaggccgaggcccataatgacgggcttttaccactggatgagataggccaggccggaaatgcgcgggaagtgtcaacgtctgcttatacgctgtttaacggttcagggaaattgcagggggcgaaggatggcggcaacagggagatcaaacactggcgaacggtggcaatcagcaccggagaaatggacgttgagacattcctcaaaagtgaggggataaaagttaaggcggggcagcttgtccgactgcttaacgttccgatggaaaaagccacgaaatttcacgaatacagcaacggtaaggaacatgctgacgcgttaaaggatgcctggacagcaaatcacggggcggcgggtcgtgagtgggttaaatggctggcaggccaccagcaggaggcaaaggacacggtaagggaatgccgcgaacggtggcgcaacctgataccggagagttacggcgagcaggtccaccgcgtgggtgaacgtttcgccatactggaggccgcgcttgtgctttccggtcatgtaactggctgggtcgtgcaggaatgccgcgacgcgatacagcataactttaatgcctgggtgaaggagttcggcacgggtaacagggaatttaaacagatggttgaacaggctgaggcgtttttgtcgtcgtttgggtttagccgctaccttccgcaccccaatacagatgagcgtgatttaccgattaaagagcttgccggatacagaaaagggagcattcgcaacgaagatgacgagatgcgctattacacgttcccgcacgtgtttgagagtgagatagcgaagggatttaatccggcgcattttgcgcgtgccctggatgctgccggaatgctggagaagggaagcgatcgccgatacaaaaaaaaggcgctgggcaagattgggggtaagcagcatgttttttacgtgctgatgttccagcctgatgatgaagattaatcccctgtgtgaggaaaaaaattgcgggttatgcgggttatcctgtgtataagtgtattaagtgtatgaatataaaggaaatcaataacccgcacgtaacccgcaaaagggcatttataacccgcaaaagcacgattataacccgcaggcgaataactgaagtaacaccggacagtcatgcgtaacccgcagaaaaaaccccgtttgcgggttattttgagcgttttgcgggttacgtgttgagcaaataataaacagggtgttttgcaacatgctgatataaaagggtaaaaaatggttagcacgctaagataacccaataacccgcataacccgcacatgtttctatatatataaattgaggtggcaaatgaccagaacacgcagagacagaacagagccgaaatataaagcgttagatataacagagctggccttaaaggtggcaatcagaacgatagaccgacacgtaggggaaggatacgcgaaggaacatcccgacctgataagcgcattcatgaccacagcagcggcaaactttgccacgttgacagaacgggagattgccgaagcggaacaggtaacaaccatcaacgttaaaaccggagaggtggaatcatgacagcacagatagcggcttacgggcggctggtggacgacccgcaggtaaaacagaccagtaagggcacaccgatgacgctggcgcgtatggcggtatcgttgccatgtagtcaggcgcaggatgggcaggcgacgttatggctatcggtcatcgcatttggtaagcaggccgacttcctggctaaacatcaaaaaggcgacgttgccagcgtatccggcacgatgcaggtcagccagtggaccggacagaacggggaaacgcggcagggttatcaggttattgcagacagcgtaatcagtgcccgtgcggcacgtcctggcgggaacagacgcaaaaccacaggcacacagggtaatcagccaccagcgggaggcgatgacccttacggtgacggtattccgttctgagggggtggcgatggtacatgaccgcatagcggaagaactcgaggcgaaaggcttttaccggagggcggcggcgcgatggggtgaagtcatgctgctggtggagacagacaaggaacggcatcaggttacgatgcgacggctggaatgttccaggaaggcacagaagccaccggagccgccggataacttcggagacctgagaaaggcagtcgatcgcacttatgctgaaatgggtatagatggtgtaagcgatgaaatatggcgtaattacccagacagctaatcaacagccggagaaatccggctttttttgcaccagttgaaacggtatggcgcattaccgggttttcgtcacggtcaggcatagttactatctgaaacaaacagacacaacagaggaaaaaacaatgccgatgaaatttgatgagatattaaaacagcgtgataaataccatgctgacaacatggagacgatgagcatcaatgattaccgcgcattcctggagacgggcgcactgattgaaaaggatcagcatggttttgtgagatgtgctctgtccggtgaaatgctggcggtaaatcctgaacagatagatgcattgatagaatttctgaaagggatcagggactgagcacgcatacagccggagcaatccggctttttgtcattttttgtaaattatttgttcgtggttgttccacgttgttcactgacaggatcggcatattttacccgaactgaatcatgagtattctcgcccgtggtgccaggacgctggggccactttcccgcctgttaatgtgctcgccaatattcattaccaggcgggaaaacgatcggtgcgattgctgatttccttatgaaaaacggttgagtttttgccgcgtcctggagttccttacttaaccccaggacttttttttatgccgagaataatcgaattacgccagcagaaaaccgccattaaaaatcagatgcgcgacatgctggagaacgcggaaaaagaaaaccgcagccttaacgatgcagagggcgcaaaatttgacgaattacgcgctaaagctgaatccctcgataaagacatttcccgccttgaagccattgcagacgaagagcgcagcaagccaggtaaaagcagccagaccactgacccggcagaactccgcaactacatcctgacaggtgaaacccgcgcattaagtacaggcgttcccgctgatggtggttataccgttatccccgaactgaacaccgaaatcatgcgaatgctgacggatgaatccaccatgcgccgcatctgtaccgtgaagaaaatcagcagcaacgagtttaagcagcttgtttccgctggcggtgcgaccgttaaccacggtgaagagggtaagacacgcgaacagaccagcaccccgcagattaacgaggtgagcattaagctgtatccggtctatgcgtacccgcgcaccacacaggaaatcgtggatttttccgatgtggacatcctttcatggctgacgggtgagattggcgacaccttcacggaaaccgaagaaagcgatctggttgtgggcgacggtgacaaaaaagcaaaaggttttttatccgtaccccgtgcagagaagaacgacaaagagcgtgattttggtacgttgcaggtaattaaaccttccgaatctctggcgtggacatctgcggacccgctgatcgacctgaaatttgcattacgtaaaaaataccgcaaaaacgcggtctgggtggttaactccacgacggcggcaaaacttcagaaggtgaagaacgcgaacggtgattacatctggcgcgaccgtttacaggcgggtgatcctgatacgttgctgggccttccggtcgaatatctggagtttatgcctgataacgttattgccctgggtgacttcaaacgcggttactacattgttgatcacgaaacaggtgttcgcaccagaccggacaacctcacagagccgggtttcatcaaaattttcacgcagaaatatttaggcggtggcgtggtggattcgaacgcgatcaagattctggaactgccacaggacgacgattaacagcatacagaaggggcttaaaagcccctttagtgttttatgggtgaaaaaattatgaagagtatggaaatccggtcatcggaaatcaccaccagcgccagcaacacgcttacaggctacgttgttcgctgggataacctttcagagctgctatggggggagttttacgaaaaattccagcggggagcgtttactgaatggcttgcggcgggtaatgacgttcgcggcctgtatgagcatgaccacagcatgttactggggcgcacccgttccggcacgctgaaactggaagaggacgaaacagggttacgctttgaactgaccccaccggataccagtacagggcgcgacgttatcgaactggttaagcgtggggacatctcggggatgagctttggctttcgctcccgtaaggatgtatgggataccacaacagatccatgcgtgcgcaccgtgctggtggcggaactgtacgaaattaccgttacatcggtaccggcttaccccgattccggcgtggagctggcccgccgttccctgtatgagcagcaccccgaaaaaatgccgcgtgcggataatcgccgctggtgggcggatttagcgggggtgtgatatgtggcctttcagaagaaaaaaagagcagcgcagcatgacgcttgatgagtttatggcgctggctggcacatcgaacacgggggcgggtgagtacgtatcatcggggacagcggaatcactgcccgccgtcatgaacgccgtgacggtcatctctgaggcggtggctaccatgccgtgttacctgtacctggtacgcaatgagaaggggaaggaggcccgcgagtggcttgattctcatccggtcgatcatatcctcaacgagcgcccgaacgcgtggcagacgccctatcagtttaagcgaatgatggtccgccactgcctgttaaacggtaatgcttatgcggtgattcagtgggggcgtgatggttttccggtggctttgcacccttacccgccgcagtcggtgaacgtggagcagacaggcgaacacaactggcgctattgcatcactgacgcctacaccggaaacacccacaactatttaccgtgggaagtacttcaccttcgttactccacggatgacggctttatggggcgctcacctgtaaccatctgccgcgaatcgctggggcttgggctggcccaacaacgccacggcgcgagcgtgatgcgtgatggcatgatggcggcaggggttatcacgtcaggcgaatggctggacggcgtgaagggcaaacaggcattagccgcactggaacgctacaaaggggccagaaacgccggaaaaacgcccatccttgaagggggtatgagctatcagcagctgggcatgagtaatcaggatgctgaatggctggcctcccgtcgctttaccattgaagacatcgcccgaatgttcaacgtctcgccgatttttttgcaggaatacagcaacagcacctacagcaatttcagcgaggcaagccgcgcatttctcaccatgacgatgcgcccgtggctggcgaactttgagcagcagataaaaaacgccctgctggtggcctcgcctgtacctggtatccggtatcaggtggagtttgacagcgcggacctgttacgggccacacctggcgaacgctttgccacctatgagcgcggcatcaaatccggcgttatgtgcccgaacgaagcccgcgaacgtgaaggactgtcaccgcgtgatggtggtgatgagttcagccaggcatggaaacaggaagtaaaaatcagcgagggagaaaaaccggaatgaacatagggcgactgcgtgacaggataacgattcagaccctgaaacagaccagagccatgacgggcgaaatactcgaaacgtgggaggacggtcacacactctgggcaagcgtgaacatgatcagcagcaaggaggccatttcatcgggcgcagagctggcgattggtaccgtaaggatctggatacggtaccggaaggacatcaacgccaccagccggataaaggtcagtacggggccgctggcggggcgtgtactgaatatcatcgggcagccgttgccggatgtcgccaggacacgccttgaaattctttgtcgtgagggcgcggaaaaatgacagaagaacttatcaccctggaagaagtgaaactccattgccgcatcgatggcgacgaggaagaccagttaatcagcggatacattgccgcatcgcttgaggcgtgccagatacacataggcaggcgctttgatgacgggctggagttcacgccagccataaagattggctgcatgatgtttatcgctcacctgtatgaaaatcgccagattgtcgcggataacgcaaaaacacgcgtacccatgacgattggtgcactctggacggcttaccgtgatgtgggggtgtactgatgccgtggcaaccattaagacgatgcacagaaccaggctgtaacaggcgcgtgaagtccggcaagtgtgaggagcacaggcgggcggcatggcgtgcagaggatgccagacgaggacaccgccgcgcgcgtgggtactccagacagtgggacaaataccgcgccatgtatctgagtaaaaacccgttatgcgtgcgatgccttgagaaggggatatatacgcccgccgtggtggtggatcacattatccccatcgatggcggtgatgatgttctcttctggcccgaatggaaccatcaaccattgtgtcaggcgtgccataaccagaaaacgaaatggcttgatccggcaacaaaaagcaagcgtgccgcaggtggatttcgtgaagaggaagaacgggccgctaaccgcaataactggatgtatgacgctgatgaatgagcgggaacaaaaccgccttatccgtggacttataaggcagcgtgacgcatggaagacacaggaaacagggcataaagataaagcgtcaggacgcgcagaacgcatcacagcgaagcgattaaccgaccgtgaccgcgaggttatggaatgtttccgcaatcgctgatgaggctgtatgacggggtggggggcgttttcaggacaaacccgaccccgccgggcaccgaacgcctcctcaaatttttatgcacgggaattttttgaaaaataatctggcgaaaaaataagcatggcaagaccaccgaaagcccccgcctacctggatgatatcgccgtgaagcagtggcgggaaaaatcgcggcagcttgcggaacggggtgacctgactcccgccgactggagtaatctggaactgtattgcgtcaattactcgatataccggaaagccgtcgcagaccttgcggcgcgcgggttcagcattgttaacagtcagggcggagagagcagaaaccccgcattaagcgcgaaatccgacgcggaaagagtgatgataaaaatggcctccttgctcggttttgacccgataagccgccgtaaaaatccaccggaaacagaagaagaggacgagcttgaccgcctggaataagtacgcagaagacgtaaaaacgggcaaaattccggcctgtaaacggttaaaacaggctgttaaacggtacttttcggaccttaaaagccccctttacacgttcgatcgtgaggttgtggagcggtttattgccttttccagggtgtgcccgcacgtaaaaggaccgatgcgtggcagacccattgagctggagccgtggcagcagttcgcctttgcgtgcatcctcggctttaaggttaaggccaccggacggcgcaaatacacgagcgcctttatcgaagtgccgcgcaaaaatgcgaaatccacgaccgccgcgattctggctaactggtttttgattatggagaacggtcagcaggatatctacaccgcagcggtgagccgtgaccaggcgcggatcgtctttgatgatgcgcgtcagatgtgccttttatcccgaccgttacgcaggcgggtgaatattcaggcgcataaggtgatacacccgaaaagcaacagcctgttaaagccgctggcagcaaaagcggcaaccattgaaggtacaaacccgagtcttgccattgtggatgaatatcacctgcaccctgacaacggggtttattccgcgcttgaactgggaatgggggcgcgtccggaggggctgttatttgccatcaccacatcggggagcaacgttgtttcagcctgtaaacaacactacgactattgctgccagatactggatggtgaagaggtgaacgaatccatgttcgtgctgatttacgagctggatgatgaaagcgaggttgacgatccggcgatgtggataaaggcgaatcccaatatcgatgtttccgtcgatcgtgaaaaactggcctcaaccatccagaaagcgcggggaataccgtcgcagtgggtggagatgatgacaaagcgatttaatatctggtgccagggggctaccccgtggatgggtaacggcgcatgggctgagtgtgccggaacgttcacggaggaagatttacacggccaggagtgttacgcggggctggatttatcatcaaccagcgatatttccagcgtatgctatgcctttccggtcggtaaaaccattatgctgatttcccgtcattatctgccggagttccagctacagaaccccgccaataaaaaccgcgctgtctatcgtcagtgggctaaagcgggctggatacgcacaacgcctggcgactgcattgattacgaccggatcagagatgacatcatgcaggacgcggagaaatttcatatcaggctggtgggctttgatacgtggaacgccacgcatctcagaacgcaattacagggggcaggttttgaggtggagccgttcccgcaaacctaccctcagattcagtccggcggcgaaatcgttcgaagtttttgttaaccgcagggtgattgtgcatcgtggcgatccggtgttgtcctggtcgatgagtaacgtcgtgatgcagagtgacgcgaacgccaatatcaagccgaacaagaaaaaatcaccgaacaagatagacccgagcgtggcggcactgatggcgtttggtacattccaggcagagcatgaggattttgcttttgatataagcgacagccaccgccagaaactggaagaattcagcggggtgtaatgaggtcagcagcatgacagaagccgaactactgggattaatccgccgcgtatctggaatcagccagcaggctgacgaacagaccacgcagccggacagcgtgacagccgaaaattatgcgcgtgttgttgctgaggtgatgtgccgtgatggtatccagcttaatgatgttgatatgcgcaacatacggatccgcgttcttgaaatgctggcctacaatcgccgcgttgaactgcatcgggagaaagaaaaaataacgtaccactggaagaagccggagcggttgcggcggtaactggttgatattttcgaaattcgccagcggcgaacatcggggaaaccagcctaacccgttgattctttcggaaacagccattggcggaatccggcgcggtaacttgctgatattcccgataacgcaaaattgcgtggctgaatgaacattatgattacttatgattacgcagatgattaaggcctaaaccgttgattcttcccaatttccacagactgtggaagttggcgcggtaacttactgagattaaagcaaagcgcaaaattgcgccgactacatccctcacatgcgaaattttcgcagtttaattactcgccagtttgatcgttaacccgctgatattttcgggaacctcaatttgaggaagtcggcgcggtaactggttgatactttcgacctcctcaatttgaggaggtcggggcacagaaaaacaacgaatatgttgtttttgggaatggtcataatgaccacgcagaccatcaaggcaaccacaacgaacatcgttacggttggagcttttaccccactgggggaaaggtattacgataatcataacacctaccgaacaggtaaaacccaccagcctgattaacagttaaccggaaaaaaaatccggtagccccgttatggggatccccatatcgacattaacgcccctcatgaattggtgcgcttccccctggaaagattacccgcctgtatatttcttgtgtctatttgttccacgttgtttcatacagtgcaccgaacggtgtagttaatggtgtagtcaatttgctgtttttagcactttttgcagtgtgggttgtttaattaaatcaatgggttgccttgctgtggtgataaaaggacatatttattcatctttcggcg

SEQ ID NO: 72 - DNA  (genomic), 46819 bp; double-stranded, linear
gatgatttaaaatcttccccaaaactttccccaaaacccttccccaaaactggctattttctatgctgttttgatatctacgataatccagtctttaccacgatcatcattgtatcggtcggtcatttttctggatttatgacctaacaacttttgcgtatccagaccctgttcccgatataaccgttctgacagagatcgctgctcatgaaatgtgggcgcagttccttgctcccattttatgccacatttttccctggcctttttaaaagccgttgtaagagtatttgcagacacctggtctcctctgtttgcttgagaggtagtgtgacggtaatggaccagatatttactaacaacagcatccctgcactgagatataacttcacgaagggtaatattcagagcatcgcatttcaggttaagcggaatagcaagttttgaaccggttttttcctgagtaatgtgcaacatgtcgtcccagatatcagagaatttcaaattgcagatatcgcttaaacgttgtccagtgacaagagcaagtagcatcccgcattttaaatagggctgccgtctgcttacgctgtcaaatattgcctgccattcgggcagtgataatctttgacggtttactcgatttcgcggttgttttgttgcctgcgctgggttaaatcctggcggaacatgtcctgcgtgttgtgcttctttgaagacgtcgatcaacaccattctcacgacttgcgccatcctgttatgaccttcagcctttacagcatcaattatttcggcaatatcaagtgcggtaatatccttgaggtgttgcattccacaatgctcacggaaaagacggatgggtttgcctttttgccgataggagttgggtcttagttcattatgttgcagcctgtcctcctggatagaattatatttatcaagccattctgtcaccgtaatgtctgagcgcctgcctttcattctttccagacgctcattgacgcttaatatttgtcgggaacgttgttcagcaataatggtatttgcttcagtagcaacttgttttgcttcattctcatcagttcctaagctatgaaaacgaccggatagtggatgtttgtattgccaatatacctttccggttcgcttatctaatttgcaatataaattgggtatagagattttgtgagatcgggggctagcagccatcagcgattatccgttggagttttgggtttgcgtttattgggagttgcggttctgcaagcgttcctacaaaacgggaatttcggtcaatcatccagtagcgaccaacttttatagcgggtggggccatcattttcccttgcgcgtattttttcagaactcgctcacttggtgctaagtccccaaattcttctttagcccagtcccgtaaagtgattagtcgagacatttgtcctcctcttagctgctgagggagtttgtgaccgatatatctgacatgatattaagctcatggcaggtacatctcttgactggtcatagagataaatttaatgctgagaaatgcagtattgaatttatcaatttttcaccagcttctggtctttctggctgtcatgcgcaaaacatatggctttaataaaaaactggattgggttagcaacgagcaactttccgaattaaccgggatattgccgcacaagtgttctgctgcaaaaagtgttctggtaaagcgtgggatttttattcagagcgggcggaataccggcattaataatgtggtcagtgaatggtcaacattacccgaatcaggtaagaaaaataaagtttacctgaaagaggtaaatttacctgaatcaggtaaaaaaagtttacccaaatcaggtaaaggcgtttacccgaatcaggtaaacacaaaagacaaactaacaaaagacaatataaaacctttttcgtccgagaattctggcgaatcctctgaccaaccagaaaacgatcttcctgtggtgaaaccggatgctgcaattcagagcggcagcaagtgggggacagcagaagacctgaccgccgcagagtggatgtttgacatggtgaagaccatcgcgccatcagccagaaaaccgaattttgcagggtgggctaacgatatccgctgatgcgtgaacgtgacggacgtaaccaccgcgacatgtgcgtgctgttccgctgggcatgccaggacaacttctggtccggtaacgtgctaagtccggccaaactccgcgacaagtggacccagctcgaaatcaaccgtaacaagcaacaggcaggcatgatagccagcaaaccaaaactcgacctgacaaacactgactggatttacggggtggatttatgaaaaacatcgccgcacagatggttaactttgaccgtgagcagatgcgtcggatcgccaacaacatgccggaacagtacgacgaaaagccgcaggtacagcaggtagcgcagatcatcaacggtgtgttcagccagttactggcaactttcccggcgagtctggctaaccgtgaccagaacgaactgaacgaaatccgccgccagtgggttctggctttccgggaaaacgggatcaccacaatggaacaggttaacgcaggaatgcgcgtagcccgtcggcagaatcgaccatttctgccatcacccgggcagtttgttgcatggtgccgggaagaagcatccgttatcgccggactgccaaacgtcagcgagctggttgatatggtttacgagtattgccggaagcgtggcctgtatccggatgcagagtcttatccgtggaaatcgaacgcgcattactggttggttaccaacttgtaccagaacatgcgggccaatgcgctgactgacgcggaattacggcgcaaggctgccgatgaactgacctgtatgacagcgcgaattaaccgtggtgagacgatacctgaaccagtaaaacaacttcctgttatgggcggtagacctctaaatcgtgcacaggctctggcgaagatcgcagaaattaaagctaagttcggactgaaaggagcaagtgtatgacgggcaaagaggcaattattcattacctggggacgcataagagcttctgtgcacaggacgttgccgcggtaacaggtgcaaccgtaaccagcataaatcaggctgcggctaaaatggcgcgggcaggaatcctggtcgttgatggtaaggtctggcgaacggtgtattaccggttcgctaccagagaagaacgggaaggaaaggtgagcacgaatctgatttttaaggagtgtcgccagagtgccgcgatgaaacgggtattgagggtatataaaagaacatcaatgggtacacaatgatgaaacaggtgagttgagttcaaactgtagtacaattctctccagtttgaacaggaaagaatatgttatgaacccttatatttatcttggtggtgcaatacttgcagaggtcattggtacaaccttaatgaagttttcagaaggttttacacggttatggccatctgttggtacaattatttgttattgtgcatcattctggttattagctcagacgctggcttatattcctacagggattgcttatgctatctggtcaggagtcggtattgtcctgattagcttactatcatgggggtttttcggccaacggctggacctgccagccgttataggcatgatgttgatttgtgccggtgtgttggttattaatttattgtcacgaagcacaccacattaaaaataatttcttttaaaagactgcaatatggcggttcatatctttacatgggccgcttttgttaatgtttttagtttttgtgtattcttttgtgccttcaagattattgcgtaagcaaattgcaatacgattattgttgtatattcaagatagtgtgatcgtaattgtctttttaaataaaaattaaacaaaaattatatctcaccactaaggtttataaaagcataagttagcaggtgtcaccatgaaaaaagccatagcatatatgcgattttcatcaccaggtcagatgtctggcgactcattaaaccgacagagaagacttattgctgaatggttaaaggtaaatagtgattattatcttgataccataacatatgaagatttaggattaagtgcattcaaaggaaagcatgcacaatcaggagctttttcggaatttttagatgctatagagcatggttatatattgccaggaactacattgttagttgaaagtctggacagactttcaagagaaaaagtcggtgaagcgattgaacgtctgaaattgattttgaatcacggtattgatgttataactctttgcgacaatacagtctataatattgactctttgaatgagccatattcattaataaaagccatacttatagcacaaagggcaaatgaagaaagcgagataaagtcaagtcgggttaaattatcatggaagaaaaaacggcaggatgcactggaatcaggtacgattatgacggcgtcttgtccgagatggctctccttagatgacaaaagaacggcttttgttccagaccccgacagggtgaaaactattgagctaatttttaaactcaggatggaaaggcgctcattgaatgcaatagccaagtatttaaatgatcatgctgtaaagaatttctcaggaaaagaaagtgcatgggggccttctgtaattgaaaaattattagcgaataaagctctgataggtatatgcgtaccttcatatcgtgcaagagggaaagggataagtgaaatcgctggctattatcccagagtcatatcagatgatttgttttacgctgtacaggaaattcggttggcaccttttggtattagcaatagtagcaagaatcctatgctaataaatctacttcgaacagttatgaagtgtgaggcttgtggtaataccatgattgttcatgcggtatctggaagtttgcatggctattatgtttgtccgatgagaagattacatcgatgtgacaggccatcaataaagagagatttggttgattataatatcattaatgaattgctttttaattgtagcaaaattcaaccagttgaaaacaagaaagatgctaatgaaactttagagttaaaaattattgagcttcagatgaaaattaataatttaatcgttgcattgtctgtcgcgcctgaagttaccgctatagcagagaaaataagactattagataaggaattacgaagagctttggtatcattgaaaactttgaagagtaaaggtgtaaattcattcagtgatttttatgctattgacttaaccagtaaaaatggacgagagttatgccgtacacttgcctataaaatattcgaaaaaatcataattaatacggataataaaacctgtgatatctattttatgaatggcattgtttttaaacactatcctttaatgaaagtaatatccgcccagcaggcgataagtgctctcaaatatatggttgatggtgaggtttatttttgagtaataatcactttttcaaccgtgctatggtatgaaagtaaagtaactactatgatattaactatcgagcaagaatatccccaggcactcaacagggcgcaggtcaacgtgaatcggtcatgacacgacaccgattttgcggaatcaatgttgcttatgaatacaacatcccgcttagtacatgttcaacacatcagcaaattttgaactgggtgtggcacttaactgaaaaaacatggatgacacaaaatgttactcgtcgcttcattgaagtagcttgtggatatcacaagctagactatcgccaatgatattcaatttttgattttttagtatcaaccttccataataatgtcaccggagcttgaacaactccggtgacttctgcgcatttaaggggacttaaatgcgaccacaatctgaactccttaccttgtcacagatgcagaaatgcacctgcgatgtcttgcatccagcgtttgatctctgcggaggtgaagcgtgaacctcccacaagatggcatcaaattacatcgcggtaacttcaccgctgtcggtcagcagatccagacttatctggaagacggcaaatgctttcgcatggtgcttaaaccgtggcgcgagagacgcagtctttcccagaatgcactcagccacatgtggtacagcgaaatcagtgaatacctcatcagcagggggaaatcgttcgctacttcagcatgggtaaaagatgctctcaaacacacatacctcggttatgaaaccaaggacctggttgatgtcgtaaccggcgaaatcactactatccagtcgttacgccatacctccgatcttggtaccggagagatgtatgtcttcctgtgtaaggttgaagcctgggcgatgaatattggctgccacctgactattccacagagctgcgagttccagctgctgcgtgacaagcaggaggcgtaatggctacaccgcttattcgtgtcatgaacggacacatctacaaagtaccaaatcgtcgtaagcgtaaacctgagctgaagccatccgaaataccaacactgctcggatataccgccagcctggttgataaaaaatggttgcgactggcagcaaggaggaatcatggctgatttgagaaaagcagcgcgtagtcgggaatgccaagtaagaatccctggcgtatgtaatggcaaccctgaaacgtctgtactggcacatatccggctgactggattgtgcggcaccggtaccaaaccgccagacttgattgccaccattgcatgttctgcctgccacgacgaaatcgaccgccgcacacattttgtcgatgctgcatatgcaaaagaatgcgcgctggaaggtatggcgagaacacaggttatctggctgaaagagggggttattaaggcgtgaatacctacagcatcacattaccctggcctccgagcaataatcgctactaccggcataatcgcgggcgcacgcacatcagcgcagaagggcaggcataccgtgataacgtcgcccgaatcatcaaaggctccatgctggatatcggcctggctatgccagtgaaaatccgtattgagtgccacatgccggatcgccgtcgccgtgacctggataatctgcaaaaagccgcttttgacgcactcaccaaagcaggtttctggctggatgatgctcaggtcgttgattaccgtgttgtgaagatgcccgttaccaaaggtgggaagctggagctgaccatcaccgaactggggaatgaatgatgtttgagtcttatatggcagaacgtcttcgccaccgctggatgcgcctgcgcttatatcgttttcctggttctgttttgaccgattaccggatactgaagaattacgccaaaacactgaaaggagctgccgcatgaatacccaatatttacagtatgtccgcgagcaactcattgtggctaccgctgatttgagcggagcaacgaaaggacagcttgaagcctggctggagcatgcacaatttgatactggtacatacaaacgaaagaagccgcgcattctggatgaggtaactggcaggatgattacgctggataatccgccgatttccggtaagcagtcgtacgcaaaaggttcatccattgcactggtcagccaggttgagttctcaacctcgtcatggcgccgcgcggttctgtctctcgaagaacatcagaaagcgtggttgctgtggagttacagcgaaagtgttcgctgggaacatcaggtcaccataacgcagtgggcatggagcgagtttaagactctgttgggtaccaggaaaattgcaggtaagacactggaacgtttgaagaagttgatctggctggcggcacaggatgtgaagaacgagctggcagggcgtaagacctatgaataccaggagctggcatcactggtgggagtgacatcaaaaaactggtctgagacatttactgaacgctgggttgcaatgaaacacatttttctacagcttgatagccaagctttattgcttttaacgaaaacacgttcaaaacaaaagaccacattttcacagcaagatattgcaaaactggattaaaaatcatatattttatgtaaatctgatattttgccaatgttgtacgcactggcagtaatccaaattcaagcccgaggtttaaagccttgggcttttctgtttctgaacggtgagtagccttccaacctaccccagccagggggtcttcagctgttgagttgatattgcttagccctctgttgccagctacatgctggcttttttattccaggcttgtggggagcatcaactccgtgctttgtcgttaaattaccccgtgagcctgatttctgacatttaacgtcccggccttttgtcggcggcgaaacattggctattcatatgcacgaaaaagagagccttgccggagcgttctggctcgttttgctgatcatcgcaggttggggcggtctggtccgctacctgatagatgtgaagcagagtaaagcaacgtggagttggataaatgctctggctcaaatagtggtatcaggattcaccggtgttattggtggcctgatcagcatcgaaagtggattcagtatttacatgattctcgcgacagcggggattagtggtgcgatgggttcggttgcactgacgtacttctgggaacgactgacaggggtgaaaaatgcaaaatcttaatcctcagcgtaaagccttcctcgatatgttggcgtggtcagaaggaacggataacgggcgacaaccgacacgtaaccacggttatgatgttattgttggcggcgaactgtttactgattactccgatcaccctcgcaaacttgtcacgctacaccccaaactcaaatcaacagccgccggacgttatcagcttctttcacgctggtgggatgcttaccgtaaacagcttggtttgaaagacttctcccccaaaagccaggacgcagtggcattgcagcagattaaagagcgtggtgctttacctatgattgatcgcggtgatatccgtcaggcaatcgaccgttgcagtaatatctgggcttcactgccgggcgctggttatggtcagttcgagcataaggctgacagcctgattgcaaaattcaaagaagctggcggaacggtcagagagagtgaggtatgagcagaataaccgcgattatctccgctctgctcatctgcatcatcgtctgcctgtcatgggctgttaatcattaccgtgataacgccattacctacaaagcccagcgcgacaaaaatgccagagaactgaagctggcgaacgtggcaattactgacatgcagatgcgtcagcgtgatgttgctgcgctcgatgcaaaatacacgaaggagttagctgatgcgaaagctgaaaatgatgctctgcatgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctcagagagaggctgatcactatgcaaaaacaactggaaggaacccagaagtatattaatgagcagtgcagatagagctgcccatatcgatgggcagctcatgcaattattgtgagcaatacacacgcgcttccagcggagtataaatgcctaaagtaataaaaccgagcaatccatttacgaatgtttgctgggtttctgttttaacaacattttctgcgccgccacaaattttagctgcatcgacagttttcttctgcccaattccagagacgaagaaatggtgggtgatggtttcctttggtgttactgctgccggtttgttttgaacagtaaacgtctgttgggcacatcctgtaataagcagggccagcgcagtagcgagtagcatttttttcatggtgttattcccgatgctttttaaagttcgcagaatcgtatgtgtagaaaattaaacaaaccctaaacaatgagttgaaatctcatattgttaatatttattaatgtatgtcagatgcgaaggatcgtcactgtattcccggattaactatgtccgcagccctgacagggaaactcctctgcgggagtgtccgggaataattaataacgatgcacacagggtttagcgcgtacacgtattgcattatgccaacgccccggtgctgacacggaagaaaccggacgtgatgatttagcgtggaaagatttgtgtagtgttctgaatgctctcagtaaatagtaatgaattatcaaaggcatagtaatatcttttatgttcgtggatatttgtaacccatcggaaaactcctgctttagcaagattttccctgtattgctgaaatgtgatttctcttgatttcaacctatcataggacgtttctataagatgcgtatttcttgagaatttaacattcacaacctttttaagtccttttattaacacagtgttatcgttttctaacacaatgtgaatattatctgtggctagatagtaaatataatgtgagacattgtgacgttttagttcagaataaaacaattcacagtttaaatcttttcgcacttgatcgaatatttctttaaaaatggcaacctgagccattggtaaaaccttccatgtgatacgagggcgcgtagtttgcattatcgtttttatcgtttcaatctggtctgacctctttgtgttttgttgatgatttatgtcaaatattaggaatgttttcaattaatagtattggttgcgtaacaaagtgcggtcctgctggcattctggagggaaatacaaccgacagatgtatgtaaggccaacgtgctcaaatcttcatacagaaagatttgaagtaatattttaaccgctagatgaagagcaagcgcatggagcgacaaaatgaataaagaacaatctgctgatgatccctccgtggatctgattcgtgtaaaaaatatgcttaatagcaccatttctatgagttaccctgatgttgtaattgcatgtatagaacataaggtgtctctggaagcattcagggcaattgaggcagcgttggtgaagcacgataataatatgaaggattattccctggtggttgactgatcaccataactgctaatcattcaaactacttaacctgtgacagagccaacacgcagtctgtcactgtcaggaaagtggtaaaactgcaactcaattactgcaatgccctcgtaattaagtgaatttacaatatcgtcctgttcggagggaagaacgcgggatgttcattcttcatcacttttaattgatgtatatgctctcttttctgacgttagcctccgacggcaggcttcaatgacccaggctgagaaatttccggaccctttttgatcaagagcgatgttaatttgttcaatcatttggttaggaaagcggatgttgcgggttgttgttctgcgggttctgttcttcgttgacatgaggttgccccgtattcagtgtcgctgatttgtattgtctgaagttgtttttacgttaagttgatgcggatcaattaatacgatacctgcgtcataattgattatttgacgtggtttgatggcgtagatgcacgttgtgacatgtagatgataattattatcattttgcgggtcctttccggcgatccgacaggttacggggcggcgacctcgcggtttttcactatttatgaaaattttccggtttaaggcgtttccgttcttcttcgccgtaacctaatgtttttatttaaaacaccccctgaaaagaaaggaaacgacaggtgctgaaaacgggctttttggcctctgtcgtttcctttctctgtttttgtccgtggaatgaacaatggaagtcaacaaaaagcagctggctgacattttcggcgcgagtatccgtaccattcagaactggcaggagcagggaatgcccgttctgcggggtggtggcaagggtaatgaggtactttatgactctgccgccgccataaaatggtatgccgaaagggatgctgaaattgagaacgaaaagctgcgccgggaagttgaagaactgaggcaggacagcgagacagatctccagccagggactattgagtacgaacgccatcgacttacgcgtgcgcaggccgacgcacaggaactgaagaatgccagagactcagctgaagtggtggaaaccgcattctgtactttcgtgctgtcgcggatcgcaggtgaaattgccagtattctcgacgggatccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgccagttactatctcccgaaagaatccgcataccaggaagggcgctgggaaacactgccctttcagcgggccatcatgaatgcgatgggcagtgactacatccgcgaggtgaatgtggtgaagtctgcccgtgttggttattccaaaatgctgctgggtgtttatgcctacttcatagagcataagcagcgcaacacccttatctggttgccgacggatggtgatgccgagaactttatgaaaacccacgttgagccgactattcgtgatattccgtcgctgctggcgctggccccgtggtatggcaaaaagcaccgggataacacgctcaccatgaagcgtttcaccaatgggcgtggcttctggtgcctgggcggtaaagcggcaaaaaactaccgtgaaaagtcagtggatgtggcgggttatgatgaacttgctgcctttgatgaggatattgaacaggaaggctctccgacgttcctgggcgataagcgtattgaaggctcggtctggccaaagtccatccgtggctccacgcccaaagtgagaggcacctgccagattgagcgtgcagccagtgaatccccgcattttatgcgttttcatgttgcctgcccgcactgcggggaggagcagtaccttaaatttggcgacaaagagacgccgtttggcctcaaatggacgccggatgatccctccagcgtgttttatctctgcgagcataatgcctgcgtcatccgtcagcaggagctggactttactgatgcccgttatatctgcgaaaagaccgggatctggacccgtgatggcattctctggttttcgtcatccggtgaagagattgaaccgcctgacagtgtgacctttcacatctggacggcgtacagcccgttcaccacctgggttcagattgtcaaagactggatgaagacgaaaggggatacgggaaaacgtaaaaccttcgtgaacaccacgctcggtgagacatgggaagcgaagatcggcgaacgtccggatgctgaagtgatggcagagcggaaagagcattattcagcgtccgttcctgaccgtgtggcttacctgaccgccggtatcgactcccagctggatcgctacgaaatgcgcgtatggggatgggggccgggtgaggaaagctggctgattgatcggcagattattatgggccgccacgacgatgaacagacgctgctgcgtgtggatgaggccatcaataaaacctatacccgccggaatggtgcagaaatgtcggtatcccgtatctgctgggatactggcgggattgacccgactattgtgtatgaacgctcgaaaaagcatgggctgttccgggtgatccccattaaaggggcatccgtctacggaaagccggtggccagcatgccacgtaagcgaaacaaaaacggggtttaccttaccgaaatcggtacggataccgcgaaagagcagatttataaccgcttcacactgacgccggaaggggatgaaccgcttcccggtgccgttcacttcccgaataacccggatatttttgatctgaccgaagcgcagcaactgactgctgaagagcaggtcgaaaaatgggtggatggcaggaaaaaaatactgtgggacagcaaaaagcgacgcaatgaggcgctcgactgcttcgtttatgcgctggcggcgctgcgcatcagtatttcccgctggcagctggatctcagtgcactgctggcgagcctgcaggaagaggatggtgcagcaaccaacaagaaaacactggcagaatacgcccgtgccttatccggagaggatgaatgacgcgacaggaagaacttgccgctgcccgtgcggcactgcatgacctgatgacaggaaaacgggtggcaacggtacagaaagacggacggcgagtggagtttacgaccacttccgtgtctgacctgaaaaaatacattgctgagctggaagtgcagaccggcatgacacagcgacgcaggggacctgcaggattttatgtatgaaaatgtccaccattcccacccttctggggccggacggcatgacatcgctgcgtgaatatgccggttatcacggcggtggcagcggatttggtgggcagttgcgggcgtggaacccaccgggtgaaagtgtggatgcagccctgctgcccaactttacccgtggcaatgcccgcgcagacgatctggtacgcaataacggctatgccgccaacgccatccagctgcatcaggatcatatcgtcgggtcttttttccggctcagtcatcgcccaagctggcgctatctgggcatcggggaggaagaagcccgtgccttttcccgcgaggttgaagcggcatggaaagagtttgccgaagatgactgttgctgcattgacgttgagcgaaaacgcacgtttaccatgatgattcgggaaggtgtggccatgcacgcctttaacggtgaactgttcgttcaggccacctgggatacccgtccctcgcgactgttccggacacagttccggatggtcagcccgaagcgcatcagcaacccgaacaataccagcgacagccggaactgccgtgccggtgtgcagattaatgacagcggtgcggcgctgggatattacgtcagcgaggacgggtatcctggctggatgccgcagaaatggacatggataccccgcgagttacccggcgggcgcgcttcgttcattcacgtctttgaacccgtggaggacgggcagacccgcggtgcaaatgtgttttacagcgtgatggagcagatgaagatgctcgacacgctgcagaacacgcagctgcagagcgccattgtgaaggcgatgtatgccgccaccattgagagtgagctggatacgcagtcagcgatggattttattctgggcgcgaacagtcaggagcagcgggaaaggctgaccggctggattggtgaaattgccgcgtattacgccgcagcaccggtccgtctgggaggcgcaaaagtgccgcacctgatgccgggggactcactgaacctgcagacggctcaggacacggataacggctactccgtgtttgagcagtcactgctgcggtatatcgctgccgggctgggtgtctcgtatgagcagctttcccggaattacgcccagatgagctactccacggcacgggccagtgcgaacgagtcgtgggcgtactttatggggcggcgaaaattcgtcgcatcccgtcaggcgagccagatgtttctgtgctggctggaagaggccatcgttcgccgcgtggngacgttaccttcaaaagcgcgcttcagctttcaggaagcccgcagtgcctgggggaactgcgactggataggctccggtcgtatggccatcgatggtctgaaagaagttcaggaagcggtgatgctgatagaagccggactgagcacctacgagaaagagtgcgcgaaacgcggtgacgactatcaggaaatttttgcccagcaggtccgtgaaacgatggagcgccgcgcagctggtcttaaaccgcccgcctgggcggctgcggcatttgaatccgggctgcgacaatcaacagaggaggagaagagtgacagcagagctgcgtaatctcccgcatattgccagcatggcttttaatgagccgctgatgcttgaacccgcctatgcgcgggttttcttttgtgcgcttgcaggccagcttgggatcagccgcctgacggatgcagtatccggcgacagcctgactgccggagaggcacccgcggcgctggcgttatccggtgatgatgacggacacgacaggcccggagttatcaggtcatgaacggcatcgccgtgctgccggtgtccggtacgctggtcagccggacgcgggcgctgcagccgtnttcgggaatnaccggttnnaacggcattatcgcccgtctgcaacaggctgccagcgatccgatggtggacggcattctgctcgatatggacacgcccggcgggatggtggcgggggcatttgactgcgctgacatcatcgcccgtgtgcgtgacataaaaccggtatgggcgcttgccaacgacatgaactgcagtgcaggtcagttgcttgccagtgccgcctcccggcgtctggtcacgcagaccgcccggacaggctccatcggcgtcatgatggctcacagtaattacggtgctgcgctggagaaacagggtgtggaaatcacgctgatttacagcggcagccataaggtggatggcaacccctacagccatcttccggatgacgtccgggagacactgcagtcccggatggacgcaacccgccagatgtttgcgcagaaggtgtcggcatataccggcctgtccgtgcaggttgtgctggataccgaggctgcagtgtacagcggtcaggaggccattgatgccggactggctgatgancttgtcaacagcaccgatgcgatcaccgttatgcgtgatgcactggatgcacgtaaatcccgtctctcaggagggcgaatgaccaaagagactcaatcaacaactgtttcagccactgcttcgcaggctgacgttactggcgtggtgccagcgacggagggcgaaaacgccagcgcggcgcagccggacgtgaacgcgcagatcaccgctgcggttgcggcagaaaacagccgcattatggggatcctcaactgtgaggaggctcacggacgcgaagaacaggcccgcgtgctggcagaaacccccggtatgaccgtggaaacggcccgccgcattctggccgcagcaccacagagtgcacaggcgcgcagtgatactgcgctggatcgtctgatgcagggggctccggcaccgctggctgcaggtaacccggcatctgatgccgttaacgatttgctgaacacaccagtgtaagggatgtttatgacgagcaaagaaacctttacccattaccagccgctgggcaacagtgacccggctcataccgcaaccgcgcccggcggattgagtgcgaaagcgcctgcaatgaccccgctgatgctggacacctccagccgtaagctggttgcgtgggatggcaccaccgacggtgctgccgttggcattcttgcggttgctgctgaccagaccagcaccacgctgacgttctacaagtccggcacgttccgttatgaggatgtgctctggccggaggctgccagcgacgagacgaaaaaacggaccgcgtttgccggaacggcaatcagcatcgtttaacctgacccttcatcactaaaggccgcctgtgcggctttttttacgggatttttttatgtcgatgtacacaaccgcccaactgctggcggcaaatgagcagaaatttaagtttgatccgctgtttctgcgtctctttttccgtgagagctatcccttcaccacggagaaagtctatctctcacaaattccgggactggtaaacatggcgctgtacgtttcgccgattgtttctggtgaggttatccgttcccgtggcggctccacctctgaatttacgccgggatatgtcaagccgaagcatgaagtgaatccgcagatgaccctgcgtcgcctgccggatgaagatccgcagaatctggcggacccggcttaccgccgccgtcgcatcatcatgcagaacatgcgtgacgaagagctggccattgctcaggtcgaagagatgcaggcagtttctgccgtgctcaagggcaaatacaccatgaccggtgaagccttcgatccggttgaggtggatatgggccgcagtgcggcgaacaacatcacgcagtccggcggcacggagtggagcaagcgtgacaagtccacgtatgacccgaccgacgatatcgaagcctacgcgctgaacgccagcggcgtggtgaatatcatcgtgtttgacccgaaaggctgggcgctgttccgttccttcaaagccgtcagggagaagctggatacccgtcgcggctctcattccgaactggagacagcggtaaaagacctgggcaaagcggtgtcttataagggaatgtatggcgatgtggccatcgtcgtgtattccggacagtacgtggaaaacggcgtcaaaaagaacttcctgccggacaacacgatggtgctggggaacactcangcacgcggtctgcgcacctatggctgcattcaggatgcggacgcacagcgcgaaggcattaacgcctctgcccgttacccgaaaaactgggtgaccaccggcgatccggcgcgtgagttcaccatgattcantcagcaccgctgatgctgctggctgaccctgatgagttcgtgtccgtacaactggcgtaatcatggcccttcggggccattgtttttctgtggaggagtccatgacgaaagatgaactgattgcccgtctccgctcgctgggtgaacaactgaaccgtgatgtcagcctgacggggacgaaagaagaactggcgctccgtgtggcagagctggaagaggagcttgatgacacggatgaaactgccggtcaggacacccctctcagccgggaaaatgtgctgaccggacatgaaaatgaggtgggatcagcgcagccggataccgtgattctggatacgtctgaactggtcacggtcgtggcactggtgaagctgcatactgatgcacttcacgtcacgcgggatgaacctgtggcatttgtgctgccgggaacggcgtttcgtgtctctgccggtgtggcagccgaaatgacagagcgcggcctggccagaatgcaataacgggaggcgctgtggctgatttcgataacctgttcgatgctgccattgcccgcgccgatgaaacgatacgcgggtacatgggaacgtcagccaccatgacatccggtgagcggtccggcgcagtaatacgtggtgtttttgatgaccctgaaaatatcagctatgccggacagggcgtgcgcgttgaaggctccagcccgtccctgtttgtccggactgatgatgtgcggcaactgcggcgtggtgacacgctgaccattaacggcgagatgttctgggtggaccgtgtttctccggatgacggagggagttgttatctctggctcaaccgtgggcaaccaccggcagttaaccggcgacgataaacgcagggtgaattatggcgataaaagggcttgatcaggcgattgaaaatctgagccgggttcgtaaaaacgccattccggcggcttcagcaatggccattaaccgcgtggccacaacggcgattaatcagtcttcatcacaggttgcccgggagacaaaggtacgccggaaactggtaaaggaacggtccagactgaaacgggccacggtcagaaatccgaatgccagaattatcgttaaacgcggtgatctccctgtgattaagctggggatcaggatgctgggccgtcgtccggacagcatacttaaagctggtcagcatcggtatcagcgggcatttatccagcgattaaaaaatggtcgctggcatgtcatgcagcgtgtggccgggaaaaaccgttaccccattgatgtggtgaaaatcccgatggcggccccactgaaacaggcgtttgatgagaatattgaccgtatccggcgtgaacgtctgcccggagaactggcatacgcgctgaaacaacaacttaggattgcgataaaacgatgaaacatactgatatccgtgcggcagtgctggatgcactggagctgcatgaacacggggcgacgctgtttgatggtcgccccgttgtttttgacgaagaggattttccggccgtcgcggtttatctgacggatgcagagtataccggtgaagagctggatgcagatacctggcgggccacactgcatattgaggtgtttttaccggcacaggtaccggattcggagcttgatcagtggatggaaagccggatttatccggcggtgactgcgatcccggcactggcagacctgattacgacgatggttacgcagggctatgagtatcgtcgtgatgacgatatggcgttatggagttctgcggatctgacttattccattacatacgagatgtgaggacgatatggcaacaccaaatccccttgagccggtaaaaggtgccggtaccactctgtgggtttacaacggcaagggtgatgcttatgcaaacccgttgtcagacgatgactggcagcgactggctaaggtgaaggatctgacgccgggcgagatgacggcagaaccctacgatgataactacctggatgatgaagacgcggactggaccgcgaccgggcaggggcagaagtctgcaggagataccagttttacgctggcctggaaaccgggagaagaaggtcagaaagggcttataggctggtttgaaagcggggatgtgcgggcctataaaatccgtttcccaaatggcacggtggatgtgttccgtggctgggtcagcagtatcggtaaggccgtgacggcgaaagaagtgatcacccgcacggtgaaagtcactaacgtgggcaaaccttccgtggcggaagaacgcagcgaaattacgccggccactgcaattaaggtgacaccgacatccggtacggtggcaaaagggaaaacaaccaccctgactgtttcttttgagccggaaagtgcaaccgacaagacgttcagagcggtttccgccgatccgtcgaaagccaccattagtgtgaaagatatgacaattacggtaaacggcgtggcgacaggtaaggtgcagatccctgtggtgagcggaaatggtcagttcgccgcagtggctgaagtcaccgttactgaagcgggcgctgcagggtaaacggaggtaatacatgtttctgaaaacagaacaatttgaatataacggtgtgtccgtcacgctttccgaattgtctgcgctgcagcggtttgattatataaagtttgtttcagacgcagaacaacaggagacaacgaagcatgatgtcgtgcacattaaccagcgatatctggaaacggcatccctgcttgtggcgatgtcgctatggcattcccattccctcaaaggcactctggcctctccggagacagagatgcagcagatccgccgtgaagtgatgctgggatggcctgctgatgcactgaatcaggcaacgaaccgggtgctttatctttcaggtatgctggataaccggcacgatgccgatcctgaacaaaccggtaaagcagaagcgactgagtcggtaacatcaaaaaagcattcgaaggcgagctgaactttgtcctgaaactggcgcgagagatggggagacccgactggcgcgccatgcttgccgggatgacatccaccgaatatgccgactggcgacgtttttactgcacgcattattttcaggatacccaactggacgctcatttttccgggctgatgtacgccgtactcagcctgttttttggcgatccggatatgcatccggcggatttcagtctgcttgctccagcgtgtgaggaagagcagacggagatgccggacgaggaagaaatgctgatgcacnaaagcgacaggagttgcccggaggcgtccggttcggangggacgganggcgcgatatttcaccttctgcggatgtggtggatgtcagcgaggatgatgttgcattaatgatggcttcagcggggatttccggaggtgtgagatatgtcccagccagcgggtgatctggttattgatttgagtctggatgcggcccggtttgatgaacagatggcccgggtacgccgtcatttttccagtctggaggcggatgccagaaaaaccgccagtactgttgaacaggggctgagccgacaggcgctggcggcacaaaaagccgggatatcagtcggacagtataaggctgccatgcgcacactgcccgcacagttcacggatattgtcactcagcttgccggtggtcagaatcccttccttatcatgctgcagcagggggggcagatcagcgattcattcggtggaccgctcagcctgcttaccctgctgaaggaggaacttctcgggatcagggatgcctctgaatcatcagaggagtcgctgtcagatacggcaaatgcactggctgaaaatgcccggaatgccggtgagctgggacgatttatgtcggtggcccgtgtggcggcaggtggcggggttgccgtactggccgcgcttgctgccgccgcctggcaggcagagcaggctgaccgggccttattgcgttcactgatcctgaccggaggggcggctgccaccacaacggcagaattgtggaaaatggccggggtgatcagcgatgaagccggtggtggtatcagacaggcggcagaaaatctggcccgtctggcagaaagcgggaaatataccgccgggcagctacggatcatgggggaaacctctcagagatggctgcagacggtgggggacgatgccgggaaggtggaaaaagcctttgaagggattgcagcagatccggtgaaggcgctggcctccctgaatcagcagtataacttcctgagcgtttcccagttacgccatattgatgagcttgagcgcacgaaaggtaaacaggttgcggtgacggaggcgatgtccctgtttgcggatgtcatgaatgcacgtctggagcaacttgataaagcggccacgccggtggaaaaaatctgggacgatgttaaaacctggacttctgacgcatgggcatggataggtgatcatacactgggggcactcagtctgatcactgacgtggtggccggaaccgttgaacaagtgaagctgctgcttgtgcagggggatctggcgctggctgaatttattcagtcagcctgggaaacgacaaagaatgtgcccggcgttggtgcgttgtttggtgaactggcagaagagaaccgcgtatttattgagaaaacaaaacgcgatgaactggcgctgagaaaatccattgcggaacgggatgcgcgtatacgccagggggaaatggggtacatcaaccgctcgcgtgcaacaggcgtcagcaaaggtccggggcagcaggaagccgtcagccgtctggctgaagagctgacaggtaaaaagcatacatcaccgaaaacgcgctctgccggggagagggaagaggagcaggcaagagaggctctgcttgcccttgaagctgagctcaggacgctggaaaaacacagcggtgcgaatgagaaaatcagccggcagcgccgtgatttatggaaggcggaaagtcagtatgcggtcctgaaagaggctgccacgaaacgacagttatctgagcaggaaaaatccctgctggcgcataaagacgagacgctggagtacaaacgccagctggctgagctgggcgacaaggttgaataccagaaacgcctgaatgagctggcacagcaggcggtgcggtttgaagagcagcagagcgcgaagcaggccgccatcagcgcaaaagcccgcggtctcactgaccgtcaggcgcagcgggagtctgaagcgcagcgtcttcgggacgtgtacggtgataatccggctgcgctggcgaaggccacatcggcactgaagaacaccaggtctgcggaggagcagcttcgtggaagctggatggccgggctgaagtccggctggggcgagtgggcggaaagtgcgacggacagtttttcgcaggttaaaagtgctgccacgcagacctttgacggtattgcacagaatatggcggcgatgctgaccggtgcagaggcagactggcggggattcacccgttcggtgctgtccatgatgacagaaatcctgcttaaacaggccatggtgggcattgtcgggcgtatcggcagcgccattggcggtgctttcggtggtggtgcatctgcttcctcggggacggccattcaggctgcggcggcgaacttccatttcgcgaccggaggatttacggggacgggcggcaaatatgagcctgcggggatagttcaccgcggggagtttgttttcacgaaagaggcaaccagccggataggtgtggggaatctttaccgtctgatgcgcggctatgcggaaggtggttatgtgggtggtgccggaagtccggcgcagatgcggcgggcggaaggtattaattttaatcagaacaatcacgtggtgattcagaacgacggcaccaacggacaggcggggccgcagctgatgaaggcggtgtatgacatggcccgcaagggggcgcaggatgagctccggctgcagttgcgtgatggcggtatgttatcggggagcgggcgatgaaaacctttcgctggaaagtgaagccggatatggaggtgaactcgcagccatcggtgcgtgaagtgcgttttggtgacgggtactcacagcgtatggcggcagggctgaatgctgacctgaaaacataccgtgtgacgctttccgtgacccgggaggaggcccggcatctggaagcgttcctggcagagcacggaggctggaaggcatttttgtggaagccaccctatgcataccggcagataaaggtgacctgtgccgggtggtctgcgcgggtcgggatgttgcgcgttgagttcagcgcggagtttaagcaggtggtgaactgatgcaggatattcacgaagaaagtctgaacgagtcggttaaatcagagcagtcaccgcgggtggtactctgggaaatcgacctgacggcgcagggcggtgagcggtattttttctgcaatgagctgaatgaaaaaggggaggcggttacctggcaggggcggcaatatcaggcatacccgattgacggcagtggctttgagatgaacgggaagggcagcagtgccagaccgtcgctgacggtgtcgaatctgtttggtctggtcaccgggatggcggaggacctgcagagcctggtgggggccacggtggtccgccgccgggtgtatgcccgttttctggatgcggtgaattttgtggcaggcaatcctgaggcagaccctgagcaggagctgacggaccggtgggtggtggagcagatgtcatcgctgacggccatgacggcctcgtttgtgctggcgacaccgacggagacggacggagcgctgtttcccggtcgcattatgctggcgaatacctgtatgtgggattaccggggagatgaatgcgggtataacggtcctgcggtggcggatgagttcgacaaccccaccacggatatccgtaaggacagatgcagcaagtgcatgcgcgggtgtgagatgcgcggcatggtggctaattttggcggtttcctttccatcaataaactttcgcagtaaatcctgttttatgacacagactgaatcagcgattctggtgcatgcccggcggtgtgcgcctgcggagtcgtgcggcttcgtgataggcaccccggagggcgaacggtaccagccctgcgtgaatatctccgcagagccggaggcgtattttcgtattgcgccggaagactggctgcaggcagagatgcagggggagattgtggcgctggttcacagccaccctggtggtctgccctggctgagcgaggccgaccggcggctgcagataaagagtgccctgccctggtggctggtctgccggggggaaattcataaattccgctgtgtgccgcacctgaccgggcgtcgttttgagcacggggtgacggactgttacaccctgttccgggatgcataccatctggcggggataacgctgccggattttgagcgtgaggatgactggtggcgcaacggtcagaacctttacctggacaatatggcggcgactggtttttaccgggtgcccctgtcctctgcacaggcgggcgatatcctgctgtgctgctttggcgcatcggtggccaatcatgccgccatatactgcggcaacggtgaactgcttcaccatctgcctgaacaactgagtaaacgggagaggtattctgaaaaatggcaacgacgaacgcattctgtctggcgtcaccgccactggcacgcatctgccttcacggggatttgcaacgatttggccgccgcctcagcctgtacgtgaacacggcagcggaagccatccgtgccctgtcgctgcagatgccgggattccgccgtcagatgaacgaaggctggtaccagatacgtattcgcggtgaggacacggcaccggaggcggtgtacgcccgtcttcacgaacctctgggtgagggggcggtcatccatattgtgccgcgactggccggagccggaaagggtggactgcagattgtgctgggggcggcagccatcgtgggctctttcttcaccgccggcgcaacgatggcgttgtggggcgcagccctgagtgccggagggctgactgccaccacgatgctgttctcactgggtgccagcatgatactgggcggtgtggcccagatgctggcaccgaaggcaaaaacaccggagtacagggcgacggataacggtaaacagaacacgtatttttcgtcactggataacatgattgcccaggggaacccgatgccggtgccttatggtgaaatgctggttggttcacgacggatatcccaggacatcagcacccgtgatgagggcggagacgggaaagtggtggttatcgggcggggatgaaaataaaaaaatcccgcagagttagcggagctgcgggagagaacgatgaagattaacgttatggagttatttttcaggcatcaaaaaagtaatgcagcgtcattattgcggctacaggcaattgccggaaatgtgaagagtttcagaaattttattccgtcatgacacaggcaccctccggggtgcctgttgttttctggcataaacagattcagacatcagacaggagagggggacagagtgggtaaagggggcggcaaggggcacacgccggtagaggcaaaggacaatcttaagtccacgcagatgatgagcgtgattgacgccattggtgaagggccgattgaaggtccggtgaaggggctgcagagtattctggtgaacaaaaccccactgacggacacggacggcaatcccgtgatacacggtgtgaccgcggtctggcgcgccggggagcaggagcagacaccgccggaaggttttgagtcatccggctctgaaaccgcactgggcgtggaagtgacgaaggcaaagccggtgacgcgcaccattacgtccgcgaacattgaccgcctgcgggtcaccttcggggtgcagtcactgttggagaccacctcaaagggcgaccgtaatcactcttctgtccgactgctgattcagttgcagcgtaacggtaactgggtgacggaaaaggatgtcaccattaacggcaagaccacctcacagttcctcgcttcggtgattctggataatctgcctccccgtccctttaacatccggatggtccgggagacggcggacagcaccacggaccagctgcagaacagaacgctgtggtcgtcatacaccgaaatcatcgatgtgaaacagtgctacccgaacacggcgattgtggggctgcaggtggatgcggagcagtttggcggtcagcagatgacggtgaactaccatatccgcggtcgcatcatccaggtaccgtcaaactatgacccggaaaaacgcacgtacagcggcatctgggacggcagcctgaaaccggcatacagcaacaacccggcctggtgcctgtgggacatgctgactcacccgcgctacggcatgggaaaacgcctgggggcggcggatgtggacaagtgggcgctgtatgccattgcgcagtactgcgaccagacggtcccggatggtttcgggggcacagagccgcggatgactttcaatgcgtacctgtcacaacagcgtaaggcgtgggacgttctcagtgatttctgctcggcgatgcgctgtatgccggtatggaacgggcagacgctgacgtttgtgcaggaccgtccgtcagatgtggtgtggcctacaccagcagtgatgtggtggtggatgataacggcgtggggtttcgctacagcttcagcgccctgaaggaccgccacacggcggtggaggtgaattacaccgacccgcagaacggctggcagacctccacggaactggtggaagacccggaagccatactgcgctacggacgcaacctgctgaagatggatgcgttcggctgcaccagtcgcggtcaggcccaccgtgccgggctgtgggtgataaagaccggactgctggaaacgcagacggtggatttcacgcttgggtcacaggggctgcgtcacacacccggtgacattattgaaatctgtgataacgactatgccgggaccatgaccggcggacgtgtcctgtccatcgatgccgccagccgcaccctgacgctggaccgtgaggtgacactgccggagaccggtgccgccacggtgaacctgattaacggcagcggtaagccggtgagtgtggacatcaccgcacaccccgcgccggaccggatacaggtcagtaccctgcctgatggtgtggagacatacggggtgtggggactctccctgccgtcactgtgccgtcgcctgttccgctgtgtctccgtccgggaaaacacggacggcacctttgccatcacggcggtgcagcacgtaccggaaaaagaagccatcgtggataacggtgcccgctttgagccgcagtcaggttccctgaacagcgtcatcccaccggcagtacagcacctgacggtggaggtgagtgcagctgacggccagtatctggcgcaggctaaatgggacacgccgcgggtggtgaagggcgtgcgcttcagtctgcgcctgaccagtggtaagggaacggatgccagactggtgaccaccgccatcaccgcagacacggagcaccgtttcagcggcctgccgctcggggaatacaccctgacggtgcgggcgataaacagctatggccagcagggtgaacctgccaccaccaccttccggattgccgcaccggcagcaccgtcgcggattgagctgacgccgggctattttcagataaccgccacgccgcatcttgccgtttatgacccgacggtacagtttgagttctggttctcggaaaagcggattgcggatatcaggcaggttgaaaccgcagcccgctatcttggctcggcgctgtactggatagctgccagtatcaatatcaaaccgggccatgattattatttttatatccgcagtgtgaatactgttggcaaatcggcattcgtggaggctgtcggtcgggcgagcgatgatgcggaaggttacctggattttttcaaaggagaaatcgggaaaacacatctggcccaggagctgtggacgcagattgataacggtcagcttgcgccggacctggctgaaatcaggacgtccattacgaatgtcagcaatgaaatcacgcagaccgtcaataaaaaactggaaaatcagagtgcggcaatccagcagatacagaaagttcaggttgatacaaataataacctgaacagcatgtgggccgtgaaactgcagcagatgcaggacggacgcctttatattgcgggtatcggtgccggtattgagaatacgccagcaggaatgcagagtcaggtgctgctggcggcagacaggattgcgatgattaatcctgcgaatggcaacacaaagccgatgtttgttggtcagggcgatcagatatttatgaatgaagtgttcctgaaatatctgacggctcccaccattaccagcggcggtaatcctccggcattttccctgacaccggacgggcggctgacggcgaaaaatgccgatatcagcggtaacgtgaatgcgaactccgggacgctcaacaacgtcacgattaacgagaactgtcgggttctgggaaaattgtccgcgaaccagattgaaggcgatctcgttaaaacagtgggcaaagctttcccccgggactcccgtgcaccggagcggtggccatcaggaaccattaccgtcagggtttatgacgatcagccgtttgaccggcagattgttattccggcggtggcattcagcggcgctaaacatgagaaagagcatactgatatttactcctcatgccgtctgatagtgcggaaaaacggtgctgaaatttataaccgtaccgcgctggataatacgctgatttacagtggtgttattgatatgcctgccggtcacggtcacatgacactggagttttcggtgtcagcatggctggtaaataactggtatcccacagcaagtatcagcgatttgctggttgtggtgatgaagaaagccactgcaggcatcacgattagctgaattttataacccagatacgggcgccagaaatggcgccttttttattgcagaaaagcgagaggtaattatgcgtaaattatgtgctgttattttgtccgcagtagtctggcaggtcgccgctgctacgccagcgagtgcagcagaacatcagtccacgctgagcgcggggtatctccatgcctcgacgaacgttcccggtagtgatgatctgaacgggattaacgtgaaataccgttatgagtttatggacgcgctggggctgattacgtccttcagttatgccaatgctgaggatgagcaaaaaacgcgctacagcgatacccgctggcatgaagattccgtgcgtaaccgctggttcagcgtgatggcggggccgtctgtacgcgtgaatgaatggttcagcgcgtatgcgatggcgggtgtggcttacagccgtgtgtcgactttctccggggattatctccgcgtaactgacaacaaggggaaaacgcacgatgtgctgaccggaagtgatgacggtcgccacagcaacacgtctctggcgtggggagctggcgtgcagtttaacccgaccgaatccgtggccattgatattgcttatgaaggntccggcagtggcgactggcgcactgacggcttcatcgtgggtgtcggctataaattctgattagccaggtaacacagtgttatgacagcccgccggttcaggcgggctnttttgtggggtgaatatggcagtaaagatttcaggtgtactgaaagacggcacaggaaaaccggtagagaactgcaccattcaactgaaagccagacgtaacagcgccacggtggtggtgaacacggtggcctctgaaaatccggatgaagccggtcgttacagcatggacgttgagtacggtcagtacagcgttattctgttggtggaagggttcccgccgtcacatgccgggaccatcaccgtgtatgaagattctcaacccggtacgctgaatgattttcttggtgccatgactgaggatgatgtccgtccggaggcactgcgccgttttgagctgatggtggaagaggtggcgcgtaacgcgtccgcggtggcacagaacacggcagccgcgaagaagtcagccagcgatgccagcacatcagcccgtgaggcggcaacccatgcgactgatgctgcggactcagcacgcgcagccagcacgtcagccggacaggccgcgtcgtcggctcagtcagcgtcttccagcgcaggaacggcatcaacaaaggctactgaagcatcaaaaagtgctgccgctgcagagtcctcaaaaagcgcggcggctaccagtgccggtgcggcgaaaacgtcagaaacgaatgcggcagtgtcacaacaatcagccgccacttctgcatccaccgcgaccacgaaagcgtcagaagctgcctcctcagccagggatgcgtcggcttcaaaagaggcggcaaaatcatcagaaacgagcgcagcctcgagcgccagtagtgcagcctcctcggcaacggcggcaggcaattccgcgaaggcggccaaaacgtctgagacaaacgctaagtcctctgaaacggcagcagaacagagtgcctccgcagcagcaggctcaaaaacagcggctgcattatctgccagtgccgcgtcaacaagtgccgggcaggcctcagccagtgccaccgccgccggaaaatcggcagaaagtgccgcatcgtctgcttcaacagccacaacgaaggctggcgaagccactgaacaggccagcgcagcagcgagttctgcttccgcagcgaagacatccgaaacgaacgcgaaagcgttggaaaccagcgcagaatcctcaaaaacggctgccgcatcgtcagccagttcggcggcgtcatcggcatcatctgcgtctgcttcaaaagatgaggcgaccagacaagcgtcagcagcgaagagcagcgccacgacggcatccacgaaggcgacagaggcagctggtagtgcgacggcagcagctcagagcaaaagtacggcggaatctgcagcaacgcgcgctgagacagcggcaaaacgggcagaggatattgcatccgccgtggcgcttgaggatgcgagcacgacgaaaaaggggatagtacagctcagcagtgcgactaacagcacttccgagtcactggcggcaacgccaaaagccgttaaggccgcgtatgagctggctaacgggaaatacaccgcacaggatgcaacgacagcacagaaagggatagttcagcttagcaacgcgaccaacagcacatctgaaatgctggcggcaacgccaaagtcggtaaaggcagcctatgaccttgctaacgggaaatatactgctcaggacgctacgacagcacaaaaaggaattgtccagctcagtagtgcaaccaacagcgcatctgaaacgcttgccgcgacaccgaaagcagtgaaagcagctaatgataatgcgaatggtcgggtaccttctgcccgtaaggtgaatggtaaggcgctttcatcggatataacactgacgccgaaagatattggtacgcttaactcaacaacaatgtcattcagcggtggtgctggttggttcaaattagcaacggtaaccatgccacaggcgagttctgttgtttcaattacgttgattggtggcgcgggatttaacgtggggtcacctcaacaggcaggtatatctgaacttgttttgcgtgcaggtaatggtaatccgaaggggattactggtgctttatggcagcgcacatcgacagggtttacaaattttgcctgggtcaatacatctggtgatacttacgatatttacgttgcaatcggaaattatgcgactggtgtaaatattcaatgggattataccagtaatgccagcgtgacgattcatacgtcaccagcatattctgctaataagccggaagggttaacggacggtacagtttattcactctatacgccatcagagcagttttatccgcctggcgcaccaatcccgtggccatcagataccgttccgtctggctatgccctgatgcaggggcagacttttgacaaatctgcatacccgaaacttgcagccgcttatccgtcaggcgtgatccctgatatgcgtggctggacgattaagggcaaacctgccagtggtcgggccgtattgtctcaggaacaggacggcattaaatcgcacacccacagcgccagcgcatccagtacggatttggggacgaaaaccacatcgtcgtttgattacggcactaaatccacgaataacaccggggcgcacacgcacagtgtgagcggtacagccgcaagtgccggaaaccatactcatagtgtcacaggcgcatcagcagtcagccagtggtcacaaaatgggtcagtacataaggtagtgtctgcggccagtgtgaatacaagtgctgcaggagcgcacactcatagtgtcagcggcacagctgcatctgcaggtgctcacgcacatactgtcggtattggtgctcatacgcactctgttgcgattggctcacatggacacaccatcaccgttaacgctgcgggtaacgcggaaaacactgtcaaaaacatcgcatttaactacattgtgaggcttgcataatggcattcagaatgagtgaacaaccacggaccataaaaatttataatctgctgaccggaactaatgaatttattggtgaaggtgacgcatatattccgcctcatacaggtctgccagcaaacagtacctatattgcaccgccagatattccggctggcttcgtggctgttttcaacagtgatgagtcatcgtggcatctcgttgaagatcatcggggtaaaacggtttatgacgtggcttccggcgacgcgttatttatttctgaactcggctcattaccggaaaatgttacctggttatcgccggaaggggagtttcagaagtggaacggcacagcctgggtgaaagatgcagaagcagaaaaactgttccggatccgggaggcggaagaaacaaaaaacagcctgatgcaggtagccagtgagcatattgcgccacttcaggatgctgtagatctggaaatcgcaacggaggaagaagcctcattgctggaagcctggaaaaagtatcgggtgttgctgaaccgtgttgatacatcaactgcacctgatattgagtggcctgtaatacctgaagtttaaaataaaagcccgcttaaaatatcgcgggcttcgaaatataaatgtattttcagaggctagagcttaggatatctcagcggcaattaacttatgagggatagctaaataccagaagataattagtttttactatttatctttgtttgtggttctccttcagcaagctcagcgccagtgacaggattgatgtcttcatgggatttcaaccttgttgccatagcttttatcatagcttcttgcttggtcgaaagatttatcgaggccttcccatccccaccgtcaaccgctgaaactggatcggaaacatagtcaaagttttcatcactgttccaactacctctgacgtcttcaccttctgacatgttgtaatatacgtttttgtatttctcaagtggtggtaattttcctggtggaaaggtgttacgaattgaatgtaatgctttttcaaatgaaagcatgtgtgctgcttcccgggtcattaaaaatgccagagtgtcttttactccaggatcatcagtaacattaatgagacgttcgtaaatgatctttgcccgagcttcagctgcaatatttgaacgaagatcggccgtgacttcgccaatagtatcaacataagctgcagtccagggtactccagctgaattagttaatgctgggcctcctccgtagaggagagaagttatatggctatcattgccattttgagttaaggaacggtaaagctcagcttcattctcagttccttcagcaagtgctccttttgcacctttgttgagcataccaacaagagaaccaataatttcgagatgacttagttcttctgttgctatgtccatcagcatatcccttcggcctgcatcttcatcacttaagccttgagtgaagtatcggcatgctgctgcaagctcaccctgtggcccaccgaattgttctaagagtagattagccaagcctgggtttggctcacttacacgtactgtatattgaagttttttcacgtgtctaaacataatgcctcctcaaaagaattattttttggcttcaactccatcaatttcagatctgaccatgaattgctcagtggtgtcaggaatatggttaagaagccattcagccatttgtttttcttcattaagaattgcttcaataatgggtactgaagctgtatcacccgcatttttggctgctgcgagaagagatgtgtaacacgcaatttcaaattgttcgaacacatagccactgatcgaacctttgacaatttcatcagatggaaaaattccaccaatggattgtccaaacgcggccattttactcatagagtctttaatgacagagcgcgaaatattattacgatcaagtatgctttcaagctgtgaaagctggttctttgtttcgctaatgtgctgctcaattctggaacgtaactcaggatagttttctatccggctggccatagactcaagcattttttcagcttgtttttccatcgcatgtgcatcacgaagccagtcatggtaatgttcaattctattcataatctgtttatcctaaaagaaattgaagtctatagttcaggagttatcctgagcttttttattaacgttattaaatgccaggtctgttaatttgacatcagtagctttttcctcttccagtgtttctttcaggagtttagccgcttttttatatcctaattgctcagcgagtgttaccaaagtgccataactggcaatttcatagtgctctactttttgtgctgcagcaatcaatgcagcatcacgtacttcatttttatcagtgctttcaattacctcattcgcctcttcgataagtccttccattgcggcacacttaattcttttcaatttaagaccatcttcagaatcaacaacctgatcgatgcgttcaatttgaccatgtgtctcatcaagatgtgactgaaaagcagcggttaatttatcactatatgcagagcgactaagtttagacagtgcctttgttagttgtttctcagcgctgtatgtatccgataataagtggatgaagatatcttcaacagatttaatttgcataatcactccagagttttcactgcgagcccgtaggctcgcagttagcttcagttattcacgaatgtagggggtgataaattaagagtcagatttacggccgccaccatggctattctgaccaccttttttccctgcttctgatgctctttgtggatcgtttttaaaattaccgccactatgttggccgcctttacgaccagcgtcagaagctttttgtcgatcttcagcgaaattacctgcaccgccacgatgttcggtcatatcatttctcctctgattttcaaattgtaaataacatgtgccttgtcagcacccaattaactctagtaacaaataagaaagtgtcaaataagagattggtatgcgcatcttaatgtgagaaatagcaattgtaaaaatgtgtactcagtgagtataatctgttgatatcttggtgattaacggaaagtttaggttgtaactcaaaagattaataaatctaaatttacatttctatatcttttgatgtgtatggcgttgtttttctcaatcagaacattctaaaaaataatttaattacacggcggtagttgttaatgtttttacgactcttcctaatgaagtctgtttcttggataaatagagaaattttatcttaaggactaattacaaaaacatctatatagccacaggaatcattattgtacttaactacaatatttgagagtaaaaattaaaccgcagacacggcgtatgcaagaacgtgctgcggttggatgctattttttccctgaagcggaaaacattactacagtaccttgaaccttggttttaacattctcgaaatgctctgagagtatatgtgttaagccttcttcggaatcttttgtgtttgaaaagatgcctttctgattgtaaatgcgcatcagtttttgaccgaagctattgtgcacaactccatcgccaagaattgtggctccgtatagagttccatcgtcagttaaggcctgcgccgcattgcgtattacacagctttttgtagatatatttccaggcaggcagtgaagaaggtaaaacatggaaatggaatcaaattgaccatgtaacgccgcgggataaggttcaaaaacatcatggctaattttatgtttaatttttgattccccagcccttgtagatgccgcgttcaggctagcttcnttcaaatccattanagatatcagactactctcaggtacgtgagtaaggtaaaacccagttccaacaccaatatccagatggttgttacctaaatgttccagaaagtgtggaagaaggtgttcctttgtaggacatccccatgcaagacgatttgatactcccaaaacccaccagtcataaagctttagggtaagtggtgtgtaaattttagccccatcatctgtgttttttttcattaatttcaccatgttatagttttatttgtgaattaaatcaattatggcgatgaattacaaggggttaaatgctgccgcagcatagcgatattgaaatagcctggtatgctgcgatacagcaggagccgaatggctggaagaccgtcaccacacagttctacatccaggaattcagtgagtatattgcgccactgcaggatgctgtagatctggaaatcgcaacggaggaagaaagatcgttgctggaggcatggaataaatatcgggtattgttgaatcgtgttgatacatcagtagctcgtaagcgtacagcctgaaccgtctggtcagaatctgacgaattagacaaagtggtgcccaccaaataagtagtgggaaccaaagtatcagatatgcagaaaaatgtgactcccggcaggcgaaaaggctgccctaattatcctcccgaatttaaacagcagctcgttgctgcctcctgtgaacccgggatatccatctcaaaacttgctcttgaaaatggcattaacgccaatctgttgttcaaatggcgacaacaatggcgcgagggaaagctgctattaccttcttcagagagcccccagctacttcctgtgactctcgatgcagctgccgaacagccagaatcgctcgcagaggacccggaaaccctcagtatcagctgtgaggtaacgttccggcacgggacgctccgcttcaatggcaatgtcagcgaaaagctcctgactctgctgatacaggaactgaagcgatgatcccgttaccttccgggaccaaaatttggctggttgccggtatcaccgatatgagaaatggcttcaacggcctggctgcgaaagtacaaacggcgctgaaagacgatcccatgtccggccatgttttcattttccggggccgcagcggcagtcaggttaaactgctgtggtccaccggtgacggactgtgcctcctgaccaaacggctggagcgtgggcgcttcgcctggccgtcagcccgtgatggcaaagtgttccttacgcaggcgcagctggcgatgctgctggaaggtatcgactggcgacagcctaagcggctgctgacctccctgaccatgctgtaaatctctttatcctggttgtcacagaataagcccggtaaaatacgggcttatgaacgacatctcttctgacgacatcttcctgctgaaacagcgcctggccgaacaggaagcgctgatccacgccctgcaggaaaagctgagcaaccgggagcgcgaaatagaccatctgcaggcgcagctggataaactccgccggatgaacttcggcagtcgttccgaaaaagtctcccgccgtatcgcacaaatggaagccgatctgaaccggcttcagaaagagagcgatacgctgactggtagggtgtatgacccggcagtacagcgtccgttgcgtcagacccgcacccgtaagccgttccctgaatcactaccccgtgacgaaaagcgactgttgcctgcggcgccgtgctgcccgaactgcggcggttcactgagctatctgggcgaggataccgccgaacagctggagttgatgcgtagcgccttccgggttatccggacggtacgggaaaaacatgcctgtactcagtgcgatgccatcgtgcaggcacctgcaccttcgcggcccatcgagcggggtatcgccggaccggggctgctggcccgcgtgctgacctcgaagtatgcagagcacaccccgctgtatcgccagtcagaaatatacggccggcaaggtgtggagctgaggcgttcactgctgtcgggctgggtggatgcatgctgccggctgctgtctccgctggaagaggcgcttcatggctatgtcatgactgacggcaaactccatgccgatgataccccggtccaggtactgctgccgggtaataagaagacgaagaccgggcggttgtgggcgtatgttcgtgatgaccgcaatgcagggtcagcgttggcacctgcagtgtggttcgcttacagcccggacagaaaaggcatccatccgcagactcatcttgcctgcttcagcggtgtgctgcaagcggatgcgtacgccgggttcaacgagctgtatcgcaatggtgggataacggaagctgcctgctgggctcatgcccgccgaaagatccacgatgtgcacgtccgcatcccgtcagcactgacggaagaagccctggagcagatcggtcagttgtacgccatagaggcggatataaggggaatgccggcagagcagcggcttgctgaacgtcagcgaaaaacgaaaccgttgttgaaatccctggaaagctggttgcgtgaaaagatgaagaccctgtcgcgacactcagagttggcgaaggcgttcgcgtacgcacttaaccagtggccggcactgacgtactatgcgaacgatggctgggtggaaatcgacaacaacatcgctgaaaatgccctgcgggcggtcagtctgggtcgtaaaaacttcctgttcttcggctctgatcatggtggtgagcggggagcgctactgtacagcctgatcgggacgtgcaaactgaatgacgtggatccagaaagctaccttcgccatgtgcttggcgtcatagcagactggccggtcaaccgggtcagcgaactgcttccgtggcgcatagcactgccagctgaataacacatccccgtcaatacggccctcgctgtacgcttacagtagctctgggtatgaagctgtttgtaactcatgttacagtaatggctattactatctcgaaggtgcaaaatgtatattgatttgatattttataaatttacttcgaatctggcacgtcaacttttgattaaagtaatatcagttttcggcgaaaaaaggaccgtgtacatgagacgatttcatacaagaataacaaaaatatgaatatgctcccaatgcaatatatgttttgcattgggagcaaatagcggaatattttgaaattattgtatttctgcttcagaatttcctgggcagtatatattttctattttttgtggagtgatcaggtgatgtacaactgctttatctacacataaattaactccggtgagagctaatgtatgcccatcaccatttattgttagtaacgggctggaaaatttctctgccatcttacgggcattaatccagggcgttgttgggtcgtatttgtgtgctacaaacagtaaaccagagggcagaacagtatttttcaggcgagttttgttcaggtcgctatgtattggccataattcacaaaaatcaggtgaatcggaacgtccattgtcaaagttaatagccgggaaggcattcgcaagagcctcttttcggaattttcgctcttctggtgttaattgctcatccccctgatctacacaaaggattacccccgaagcatcacttgactcttctgaggctatcggagcactgagcgcagtttcaatttcattactgacaatcccctgagagaactggcgtatggcagttgcaagggttggccatgatgaacgccatagcagaaggtctgttgttaatgatatgagttcatctgaagatatattttctcccttactgtctaataaaggtttgtgatgtaattttgataatagctcatggaactgagttattgccttatctctgtctgaagaaagcgggcaactttttgtacgcgcacaccaggatgcaaagcgatcaaacgtttcctgataactctgtgcctgtttgagttgccatgtgaagttgtcctccaggtcatcgatatcgacgactccatcaagaacgatagatcttacgttgtagggaaaacgttctgcatataaggctgcaatttgagttccatacgaatacgccacggctgtcagttgtttatcccccaaggcttgcctaatacgatcaatatcgtatacagcctcgttagagccgatatggcgaatgacttcggctccggtattatggatacaggcattaattttatttaatacttgttgcttttcggttatgttttcctgagtctctgtatctgattgccggcagtttattgtcggagtggactgcccgacgcctcgaggatcaaatccaataatatcccatgactcacgaagatttgtgactggccagtcaaagttaatataaggatttatgcctggtaacccgggaccaccacttattatcaggatacttcctttatgcttgctttttgccggcaattttgtcaacgctagtttgacttgtgattttttttcataagaagcatctccgcctgtgtctgtatattttaatggaacagacaaataaccacatagtaagtcaggagacggtttttcctcaccaaaccagtggttgaattgactggccatacaggattgccactgtatctgctgggcagatacggttactggtagaagtaacgttaaaacaactttgaaatgagtaattatttttcgcattgtgtctctgaatatcggaataaagataaaatttgaatatattgaggtcttgtgttgcggtaagagattacacgttatgacataggttaaatgcttacaaaattagtggatattgtctacttgtaactgtaaacaaattccccggggttatacaataccaccggggagaaaatctggttaacttcgttaaaaggtgtacttaagaccagcagtagtgatgaagttatagttttctatgcctgcaccatttttgctgtagtctgaagtgttatcattgtgatcataaagtgaagtattaccttttttattcgtaacccgattccatgtgccttcaacataaacttttgcgttaggtgttacgtaataacctgcattgactgaaacagaatagtaattttggtctttgactttactgcgataagtgattctttttcctgggtcatagtgctcatcgttatcagatgcttccacccagccgctgtatttaaatgtgccacctagctcaaaatcttcataacgataacttccagtcaagccaatgtagggcattttaaaacgttgtttgtagccgattgctctttctccattcgggaaggagccgatatcatctctgaatccctcctcagaactgtagatataggaaccacctctggctgtaaagctataacggctttcctgatatccggccatgagtcccaggcggtaattgggttcgttgaggagccagcctttgatattcagatcaaattcgttggcataattgagttgtgtatcagggtgtctactttcatccgtccaggttccggggttactggaatccatccagtcctgatcgaccatattgccacctcggctgccgagagttgtccagccagcagccccgatagatatctggggcatcaaatcccaattaattgcacctttaataattgcagcgttattgaatttccagtcgagttgactgacttttcggcctccttcttcggctagataaacacgctcttttgtttttccgctcagagttccaagactaatgtccgcatttatgttgtcaggagtaaacgataaagtctcggtagaagcaaaagagctgatcgcaataggggttgtcaggactattcccagaagtttcgcccgcataaaaggtctccattcaatcgttttaatgattgaatatgtattttttatatctaacttaatgagtcaattgtatattgtttaactgtttatggtttgtttaagtttgaattattgtttcgttttattcattctttatgggcagcttgccaagtgttggtattattgttgtggtttaatatgctggaaattttctttttgctgatatttttatctgtctatagttattcatttatacgcatattagcaaaaaaaatattattttaggtatttctacagtacatttgacacgatgattaacctctatgtagctaggtttttgtaaagaaactgtgcgtcactgtatccaggactgttatgtgccaaataaggaagttgaagttaccagctcttactctaaagctataacgtatagaaaaaatgcatttgagacgtgtaaaatcatttatttaatcgcaatttatgtaatggcataatcaggtcggtgaaagaggggagaagaatggataaaagagctaaaaatcagatagtcgatagcgatattgcacgtttgttactcaagctcagaaagtctcgaaacttgactgttacagagcttgcccaacgatctggtgtcagtcaggcgatgatcagcaaagttgaacgaggcacttcaagccccagtgcaacaatacttagtcggttagctaatgcactgaatattacgctatcaaagctttttgcagagcttgagatgcaacagaattcacttgtacttttggctgaccagcaacaacattggattgatgaagaaacaggcattacccgctggtctttgtgaaccgccccggaaatcctggagactaaactccctgagaaagaggtaaacaggatgactaaaaatactcgtttttcccccgaagtccgtcagcgggcgattcgtatggttctggaaagtcaggatgaatatgactcacagtgggcggcaatttgttccattgccccaaagattggctgtacgccggagactctgcgtgtctgggttcgccagcatgagcgggataccgggggcggtgatggtgggctcaccagcgctgaacgtcagcgtctgaaagagctggaacgtgaaaatcgtgaactgcgccgcagtaacgatatccttcgccaggcttccgcttattttgcgaaggcggagttcgaccgcctctggaaaaaatgatgccactgctggataagctgcgtgagcagtacggggtcggaccggtatgcagcgaactgcatattgccccgtcaacgtattaccattgtcagcaacagcgacatcatccggataaacgcagtgcccgtgcgcagcacgacgactggctgaagagagagatacagcgcgtatacgatgaaaatcatcaggtgtacggtgtgcgtaaagtctggcgtcagttgttacgggaaggaatcagggtggccagatgtacagtggcgcgtctcatggcggttatgggacttgccggtgttctccggggtaaaaaggtccgtacgaccatcagccggaaagccgttgccgcaggcgaccgcgtaaaccgtcagttcgtggcagaacgacctgaccagctgtgggtggctgattttacttacgtcagcacatggcagggcttcgtctatgtggcgtttatcattgatgtgtttgccggatacatcgtggggtggcgggtctcatcgtctatggaaacgacattcgtgctggatgcgctggagcaggcgttgtgggcccgtcgtccgtctggcaccatccatcacagcgataaaggctctcagtatgtgtcactggcctatacggagcgactaaaagaagccggattactggcatcaacagggagtacaggcgactcgtatgacaacgcgatggctgagagcatcaatggtctttacaaagcggaggtaatacaccgtaagagctggaaaaaccgtgcagaagtggaactggccacactaacgtgggtggactggtataacaatcgacgattgctgggaaggctgggccatactcctccggcagaagcagaaaaagcttattatgcttccatcggaaacgatgatctggcagcctgagttcacagataaaacactctccaggaaacccggggcggttcaccactgatgcgggtgccgggtttgagcagacgctgaccggaatgacagtggggatcgacagccgtaatgatattcctgaggggattgcgacgctgggcgcttttatgggttattcccattcacatatcggttttgatcgtggaggacatggcagtgtggacagttattctctgggcggctatgccagttgggaacatgaaagtggtttctatctggacggtgtcgtgaagctgaaccgttttgaaagtaacgtagccggtaaaatgagcagcggtggagccgccaatggcagttaccatagcaacgggctgggcggtcacattgaaaccgggatgcgatttaccgatggtaactggaacctgacgccgtatgcctcgttaacggggttcaccgctgataaccccgaa

SEQ ID NO: 73 - DNA  (genomic), 33 bp; double-stranded, linear
gttgtcggcgctctctgtgtggagcacctcatt

SEQ ID NO: 74 - DNA  (genomic), 92 bp; double-stranded, linear
attcgggttcatgttcagaatgttgattaacaggctgcttcttctgatgttggaatgtgcatatcaaaatcaggaaatgacaagtttatata

SEQ ID NO: 75 - DNA  (genomic), 1313 bp; double-stranded, linear
tgaaccgccccgggtttcctggagagtattttatctgtgaactcaggctgccagatcattatttccgatggaagcataataagctttttctgcttctgccggaggaatatggcccagcctttccagcaatcgtcgattgttataccagtccacccacgttagtgtggccagttccacttctgtccggtttttccagctcttacggtgtattacctccgctttgtaaagaccattgatgctctcagccatcgcgttgtcatacgagtcgccagtactccctgttgatgccagtaatccggcttccttaagccgctgcgtgtaggccagcgatacatactgagaacctttatcactgtgatggattgtgccggacggccgacgggcccacaacgcctgctccagtgcatccagcacgaatgttgtttccatggatgatgagacctgccatcccacgatgtatccggcgaacacatcaatgatgaacgccacataaacgaagccctgccatgtgcttacccaggtaaaatcagccacccacaactggtctggacgttctgccacgaactgacggtttacgcggtcgcatgcggcaacggctttccggctgacggtagtgcggacctttttaccccggagaacaccggcaagtcccataactgccatgagacgtgccacagtgcatctggccactctgataccttcccgtaacaactgacgccagactttacgcacaccgtatacctggtgattttcatcgtatacgcgctgtatctctttcttcagccagtcatcgtgctgcgcacgggcactgcgtttatccggatgatgtcgctgttgctgacaatggtaatacgttgacggggcaatatgcagttcgctgcataccggtccgaccccgtactgctcacgcagcttatccagcagtggcatcattttttccagaggcggtcgaactccgccttcgcaaaataagcggaagcctggcgaaggatatcgttactgcggcgcagttcacgattttcacgttccagctctttcagacgctgacgttcagcggtggtgagtccaccatcaccactcccggtatcccgctcatgctgacgaacccacacacgcagagtctctggtgtacagccaatctttggggcaatggaacaaattgccgcccattgtgagtcatattcgccctgactttccagaaccatacgaactgcccgttgacggacctcgggggaaaaacgagtatttttagtcatcctgtttacctctttctcagggagtttagtctccaggatttccggggcggttcaatc

SEQ ID NO: 76 - DNA  (genomic), 6737 bp; double-stranded, linear
ccagaaattgcgaccttcttcaacaaacccttcactgtaggcatattgggtatcaaacaggttattgaccgacgcattgacgctgaagccatgacctaaggtgtaatcggctcgaatgtgggtcaccgcaaaaccggcggctttttgtgaaccgtcactgttactgtagctggaggaacgcgcctcttccgacagcgttacgcttaacggctcccacggtttgagagtcatccatgcggtcattgtctgcgttggcagatcggttatcttgccgatgtctttacgtttggcgtcagcgtggatcagggcgtagctcaatcctacatccagtatattgctgattttccccttaataccggcatccagaccgctgtaatccaccgtgccgctgttctgattttgaatggtatcggcatcgatattgtgcgagaggatggcatcactcacccggttatagtaaacgctgacctcaaatccccagtcgtgcgtgaaggcaccattccaggttaaatccaccccgcgagcgcgttccggcttgagctgcgggttaacaatcgctatctggttatacgcaggtttggatgtggtatagcgttctttcagcgtcggaaagcgtttgcggtcatagtacgaaagcgccagcgtgtcttcattgacaaagtggtatttccccatcacctgccagttaaaagctgactgattgttgtcgtcataatgggtgatgctgccatctttctcgtgttttttcgcttctacgctatcgcgccagtcatagctgattccagccacaacatcgacattatcggcagcagcccattgatattcactggcgagcgaccaggtacgatcttcatagcgatcgtaagcggcgtgcggcgcacctttttcccggtgtacgtcatctttccagttaacggcaaacgtcagcagatcgttttcacgcacatcggctgccagttgtaatccggcaccgtcgctgtaatcggaataatggctgtagctgccttttttatttttcaaatcagccagcgagttgtacatcatcagcgtattttcaaaggtgtcgcgatacagccgacttttcagggtaaaacgatcgtttagttgggtcgttccctgataataaaaactttctttgtcatactctggccactgccagtagcgtgatttttgaccactatttccgctgtatggcgggttatctttttcaccatcctgcttaatgtaagtcagtgtgtattcatcgttttcacgtggtgtaaatccgagcttcacaatgccgcgtttatcatcagccgatgaattaatcatcttgccgtgtttgcctgcaatatcattatttacaccatgcggcaggccgagaaaatcctgctttagctggctaccgctgacttgcaaataccccagttcgctgctggcggcaaatgaagcatgcatatcataggcattgtcctggctacggctccatccctggcgatatcccagacttgcttccagaggttttgttggcttctgggtggtgatattaatggctccgcccatctgattaggtccctgaagcagcgacgaataccctttggaaacttcgactgcccccagattgttggtcagaatccgcgccagatcgaggttgccgtcatagggaacataaatgggcacaccgtcgaaatagaccggcacctgccgactatcaaagccacgaacttttacctgttcttcgttgcggctgcctgacttttgcagcaccacgccggggacgacacttaatgcctgagcgacattctgtttatccagggccttcatggtgggttgatcgagaacggtggtcgtcgtcgatgataccggactggaccatacggtcagcgagtcgctctcctgagccgctacggcctgctgggtaaaggcaagtgataatgctgtgcagagataatgttttttgagtctcatagaataaattccgtttaacaaagaattaaatagaggctgcgggttgcagactgactttaatgtcagccggtgccgcgtaataaggcgcggaggtaataaagaggcgaatgccgcagtcgaggtaatttttgagtgtcgtcagattaattccgccggtcagagccagcgtgcagtggggagccagcgacggcgctatttgcgcaatttcagttgcctgttgcggactaaatttgtcgagctgaagtacgtctggttgcgcgcgtaacgcggcgattgcctctttcggcgtgtcggcttcaacaacaattttcttctcgggtgcgtggcgacgtaactgattgattgcgcctgaccagtcctgattgtcatgaagaaaatggcggtggttggcaaacaataatatggtttccgcacatccggcacgatgaatcagtcctccggcagccagaattgcctgcgaggccagtaagcgggtgcccggaattgcttttcgggtgcaggcgatattgccatcaggataacgttcacgaagtaacgccagcatttgatcgagataatcagaaacaccgcaactccactccagcacattctggattgccttccatccctgatgaagtgctgcggcattaccctgcgcacggattagccgctgacccgcgttcgcttgtgaaccgtcgctgaccgcgtcatcaatagttaatcccagcgtagttaacatcttacacgcgacagaaacgccgctgacgcagccgccctgacggagaaaaaactctatatagccatgctggtgtccaatatttaatgctctcgtggtcaggtcaccgccctggatatcttccagaagtaacgcatcgatttgtgcctgagaaaggaaaatcatcgcagtgcctcctgcggtacgctatcccaccagatgagcgcccagtcgcggctggcaggggcgagggcacgagcatcttgttgttgataccagcgatataaccgctcacgctcatcgtcgttaagcgcgccaagactccagctgacgttctgctcaaaacgttcctaggtgctgttatcctgttggcaattttgtccacggataaaatcaacgtgggcataaattcccatctgatacaggacgttgagcgcaaagatatagttgggtaattcgatcacttcccgaccagccgcccgctgaatggctggagagacgaacgaggtgctgaccagatgagtcgtatagacgcgaagccgtgcctgattattcagtttgctcattgcctggcgcatatcagccaccagagtggagcgggaagccacggcaatatcgcagcgtggcaggtcactccagtcctcttcccaggcgcgctggatcaagtggacattgtctgccttcagcgcggcggcgcgacgggcggcaacgttcagcatcccctgactgtaatcaacgccataaatcgtcgtgagtttgtcagccagcgccagcgatacggtacccggtccgcagcccatatcgaataaggtctgagcgccttgtaggtcaattttagcgatcagttgttgcaggtagctgtccgtaggcgaggcgcaattttccgccattttttccgcccgttgatcccagtgatccggcgttttttctgtgcggtgggccagcttgagttgctgcagataaaggtctgcaaaatcaatatcatcaatgagcatgatttttccttagtggctaattgcagagaggtgatgatgaatctggtcggcagaaacccgatacagggcagccagtttgtttgttgttaactgttcggtcggtaagccttgtgttactcgtccatctggctctacctggataatgctgtcggcaatggcgttggcatggagcggatgatgagtcgacattaacattgtcatgccgttatttttgagctgtgccagcgtgtccagtagttggatctgatgaccgaaatcgaggctggaggcaggctcatccagtaacaacaagcgcggttgctggacgagtgcacgggcgattaaagccagctgacgttcaccgccgctaagcgtattccagcgtcgtgccgccagatgcaaaatgcccagcttttccagttgctccgtggctttcaggcgttcttgcttaccgggaacggaaaaagcgcctatggtgggggccaggcccatcaacaccatatccagcacactaaaagcaaaaataccgtcgtgcgcctgcggcacccaggcaatagcctgcgcgcgctggcgatggctgagtgtctgcacagggaggctatccagtaagacctcgccttttaataacggtataacgccaagaatggagcgcatgagtgtggttttgccgcaaccattggctcctaacagacaacaaattgttccttgcgacagggtgaaggacacgtcgcgtagcaccggatggcgggagtaacccagagacgcatgacggacggcaagcaaagtcactggcgacctccgcgtaacaacaaaagcaggaaaaacggtgcgccaacaaaagcggtcagaatgccaagtgggatttctgttgttccaatgctgcgtgccagcgtatcggtaagcaggagcagaatcgcgccagtacacattgccatgggcaacagctgctgatggttatgaccggtcaacaagcgggcaatgtgcggaacgaccaggccgacccaaccaattatgcccgctattgctaccgtactggcggtgattagtgtggcgcagacaatcaatacaaagcgcagacgcgtcacgttcagtcccagcgaacgggcttcgtcgtcggaaagcgtgagtaaattcatgcgccagcggagaaaaaacaggggcaaggagcctatgagaatgatcggtgcagcatagcagagatcgcgtaaggtcacggtggacagtccccccagcaaccagaaggtaattgacggtaactgggtgtaaggatcggccagcgttttaattagcgatatccccgctccgcacaacgttcctaacgcgatgcctaccagcaccagggttaagatcggatcgtggcgggtcacccgacgcgtaatcaaccagacgcccgcgaccaccatcagcccgccacaaaatgcgtacagctggatgtaaacaatggataatccccacagaattgccgtgcaggcaccaagtccggcaccggcggagacgcctaaaatatccggtgaaactaagggattacgcaacattccctgataggtggttccggctcctgccagcgccgcgcccagtaacagcgcagcaagaatacgcggcacgcggatttgccagaagacaatttgttcctgcacaggaacattttcttgacgaagaattagcgccagcagttgctgcatatcgagatgataagccccacttacggcggcaaaagtgatactgatagctgccagcagcaaaatacatccgtttacgattctcattaggtcgccaccaatttttgatagtcggcgtcactgagtgaacaatgccagaacagttgggcgtaatgctgcatgtcacttttaaactggcgattgatggcgggatccagccaggcgtgaagtctgcgtaatcccagaagacggttgattcccggtggggcatccagccagccaaagggcaagccacttaaaaataagatgcgttgttctgcaacggctttcacgccatgccagagaggatcacgacgaataaaatctgcagtaacggcctcctgaaccagaataatatccggctgccagcgcaggagattttccatggaaacctgtgtcaggccttggcgatcggctatttgcgcgacgttgtgcaaacctaataattccgccgcctcggtatgcaacgaaccctttaagcccgtctccagccctcgagggccgcgcgcagcataaaagcggaggttagcggcgggtgaggcggcgaatgcctgagcttcaccaacgaagcggctggcgagattggcttgttctgcggcgcgatgctcttcgcctaacgttttgccaagcgttgttaactgttctgctgattgcgccagtttcccgttaagcaataaccagggtatttgtgtctgttcgctaacctgccgtgcctgggagatccaggtttcatccgtattgccgcaatcaacgaccaaatcgggatgtaacgccataagcccttccagcgagagtgtgctggcgcgcccggcgagtcgtcccagcctgggtaactggcgaatgtgctctgacaatggaattaatgcctgacgggcaaaatcaaaagaggaaaaaccgaccattttttctggcgcgacagccagcaatagcaaatcggcgggcgcacctgcgctgacgatgcgtgtaatgttttgggcttcgggaagcgtcagtgaggcccagaatttgactgattgtgcaaaagaaggcagatgatgcaggaacaacgtcgacgcaagaatctgtgtaaacctccgtctggttagtgacataagttatatcctgataattaaaaccgctatatatttacatatatatcgaaaaaaatcatgtttgatgtcaaaatttgtctaaagagacagaatgatttgcttgttgcttaaataacactttgttccacaagaaaattgtcagggagaatggcggagtggcgaaaaatataaatagaggtgtactgattaacaaattgataaaataaaataaaattaaaatcttctctgatataagaaaataaaagcatagaccgtagaatggggggcatttcgtggcgaaaaaagagcaatgccaattttatgcacataatggcattgctcgatatacagcaaa

SEQ ID NO: 77 - DNA  (genomic), 75 bp; double-stranded, linear
gatcgcacgtaatcacgttattcggggactttatctgcgggatattacccttcaggtaagtccttttctcgccag

SEQ ID NO: 78 - DNA  (genomic), 41 bp; double-stranded, linear
caggntgtggtacatgctcgcaattctgaattaacgacctg

SEQ ID NO: 79 - DNA  (genomic), 38155 bp; double-stranded, linear
ttctctgcaaaacctctgcaaaacccctctgcaaaactggtcatcaaatgaccagttttttccattccttaccgcgtgcgtcgttgtaaatatcggtcattttttgattcgaatggcctagcaaaattttggtatcaaccccctgctctctgaacaatcgctctgataaagatctctgctcatggaaagagggaggggtgccattagcacgccagttgtaatccacagaatcccgggcttttttaaatgcaacggttaatgttgctggcttaaccatcccgccgcgcttagctgtccctttcgcgtgatggtggtgcaatagccacggactaagaacgcaatcgcggcaggatgacaccacatcatccagggtgagatttaatttatcgcaacgcagagccagagggatggcaatccgggttcctgttttttgctgttcgacatgaagataaccatcccggatatccgaaaattgcattttgcaaatatctgaaaggcgctggcctgtcatcagtgccagcagcataccgcgctgtaaaaagtaaccatccttttccgctgcgttataaatcatcatccactcatcaaaagtcagtcgctgtcttgatatccgcacctgcggtttttttgccgattctgcagggttaaagcctggcgggacatcgcccgtttgctgagcttcccggaaaacatcgatcagtactttcctgaaaatttgtcccattctgttatgtcctctggccttgtactcttccagtactgataccacatcttttacggttatggcatctaacggtctggtgccaaaacgttcatcaaataccctgagaggggccgctttctgtttcagcgtgttgagtttgatctcgccgttttcatatctttcctgttgaatttttctgtaattattcagaaaaatggtaacggttgatgaaccgccggtatcactaataattttctcctgcagactgagcatttgttccatttgctgccgggcaagacggctgttcgcttctgctgcaatagtttctgccagtttctggtcaatactgccgagaccgtgatttttgcctgttatgggatgcctgtaacgccagtaaactttgttatttcttttgtcaaaatacggagataatcccggaacatcggttttatattttcgcgggcgcgccatcttccagtatcctcttcaaagcagggtgatctgtggcgatcacctccggcttgtttaccattccgacaaagcgagcttgcggatccactcgccagcgtcttccaacttttttggggagaggaaatatcattccggctttagcgtatttacttaacgtactcggagttgggaccggttcactgaattcctcttttgcccactcagtgagcagaataagtcttgccatgagcgtcgttcgctaatcatggtcgccgccactatagctggtgggcaacgaccggggttgaacattaaaaatcagcctgattcgggatcagtttttgccagataactgaaacgtattttgcctggtaacgggcgtcatcaagtgcattatggcgctcaccttcgaatggaatagccgttctggcatcgaagtctatggctttccccagctcaacgattgtgcgtacatcgcgatcgttgtagtaacgccacgggcaggggatcccctgccgttcgtatgaacggcgcaaaatcgtgttgtcgaagttggctccatttccccagacctgaacaaaaaattcaccggagttttcgtcgataaattcccgcaattgtaatagtgcatcatctaacgggatttcatcggtcataatggcagattgcgcttcgcgtgattgcttaagccaccatttaatggtgtcccgatcaatgaccccgccagcagtttccagatcgatagtcttactaaattccggtcccatatctccggtttgcggatcgaaaaatattgcacctattgagatgatcggggcatcaggattttttcccatggtttcaaggtcgatcattagatggtcacacgtcctgctggtggatgtgatttcttgatgaccgttcaccttaattgagtgatctgccgtctcgccagtttcattatcgctatcgtgatgctgattgccgtcagtgttctccttgtgtggatgttcagcgccttccatttcctccggatcatcttcctgaacttcaacctgatactcttcatcgaatgtttcctggtatgttgcgtcgcccatcaccgcgccacaatcagggcagttgccgccgccggtctgaccgcaggcggtgcagactttttccggttcctgttgcgctactggctcaggttgtttcgtttctggctcgttttgttgcgtatttgggctgttttgttccgctttctggtcgttctgttccgtttcttgctggttctggttcacagaatcgcgggtttcaatccccttcacccatttcggatcattcgggtcgctaatccctgcaacaaattcaccacgtgatgcggcgagcaactgattggcgtcaggctggctgatattggctgcctgcataattttctttacttcgtcagcggtaacttttaccggttctggttgttcagaattttgtgcggtatttgcattttgcggtaagcctgtgtatgtgccattttttcgggcaaaatattcttcttttgtgatttcagtagccccggcagccagcgccttatccagaccagaaagtttgtttgcgcgaccgtatttttcgccatccttgtcggtgaagaggaagtagaacggcccctcacgctctacagatggttcgacttccactttgcattcggttttttcgttgtccggaattgccgtttccactgcatcagtttctggtactggcgacgagagagtgtcagttgcgctctgatttgttccttcatcttcaaacacgccctttgtagtcaggtattcagtaatgtatttgttcagtgccacagggtctttgtgaatgtcgatcggacgttcacggacaaggccaaaaatagtctggcggtcgtagcgaagggcatcaggctgtttgcgcattgatgccgagatacgcttccagtcttcgcggtcgttgtcgataacttcattttttgcccagcgatggatgctgccgtcaatgtttccggcatccacatcaccaggccagagagcgtaggccagttcgtcatccagtgttttccatgtctgcttatattcgcgacgaatgactgcagtgacaggggggattttttctgctgagttttcagtgtgctgtcggtggactctggcgcgggcgagatcaacaacagacgtgtattttccggtttccttgcgttcaccttcgcgacgttttttccagatgcgcatttctgcctgaatttcgggccatttggcaccaggcttacatttatgcttaacccacccgatggcatgcagcttaagctccggatacatggcgttaacttctggcattttcatcaacgcttcaacgatatgtccgtcgaatgttgccatgtcttcctgcaacaattcctgcgcgctaatcaccatatcaacggtgatgttttcacatgtgtcgaacttaaccatgacagcgttctgtacttcaggggccagcttgtcaaaagcgacgttcatcggatcggattcagtctcaaccgggacaaaggaagcagccccctcatcccagcggttttcctgcatatattcagcatcccaggaatcgagggcagggcggggtataccgggtttatcctcgcaaacaagaaatttataagcgcagtcctgagcagccggataatgctccaggaattgccagtgaaattttgcgcgggcgcgacgttcatcaccggcttcaatggcagtggctacagcgactgcaccttcttcctttattgcctgttcgtccggaatggcggcgcaaataaagactttactcattttgttttacctcattacagatttaagggtgaacaaatccctgccattgctggcatataagaatgaaatcggatgtttattacggaactgttttaaagacctgccgggatttcgttattatcctggtgaataactttatcgacagggtaacagttaccgggaattttctgttcggttgctgcagtcacacactcctgcattgtcctgtgaacactgactgcaatatcaactggctctccggaaacaagaaaaactgtcagaacaagtgcaaatgctgtattcattgccagcatcctttttgtatcggacgtaaacgggccagcattgaaagaatgcatattttatttaataactcccgttcgtgttttctcttgttaatggcatcttcagtaaatacagggttactgatagtgacaccaatttcaaaacaaccttcagacgtattaacgtttggtaataacgtttccattatcgcgtcctcaacaatgaattttgtgatgcggtgcctggtgcctccaggtgacgttaaccagttaacaattaacgccggatacagagaatccccccataacactgtttttggttttaactgttccgcgtgcgcttagccgcattcactgcatcacaaaattcactttaaaaagggcggacatcagttcatgggcaaacagatgccgccaaacgtcaccagaaaattgataacagagggcgttgcagcggggttgtcacttaagcgtatggtcaacctgacaacccggtgtcctcaacggggaaggaataaccccgccatacttaccgctgcgccatttcgcgttatgctctgacttttcagagaaatatcctttcagtaaactgtcagtgccggatgttcacccgtgtccggcgcacgcactccacttcacccgtggagaactccttaattaccaaccctcaggagggtgaatgttaaaatcaactcttattgctaaatgcctttatcaaaatcgcatggtaagcagcatttcaataggcgagtctgcagttaaaagtattttcgaagagtactttcccgggcatgattttaataaatggaataccaaattaccgccagcagtttcaacgcgtattctgaaagcaaccgaaagagcaagtacaattcgcgttaactatttcattaaagatttgtgggatctttgatatccacagagcctaaagtatgtgcatatggatgtgctattatgcgccctcgcagatttgcatcattttctaaattcactgaacgaaacagggcatcaacaaggctctgtacaatgcaaaggcaatcgaagactgtcgccgtttctgttttgattgatgaaagaacatggccattcacgcaaacagaaattacccgtttattaacatcgctttcctgcttttgattatcagaaccatatagcccagaaaaagcattgcgcacattacgaaccatattatcgatggtttctttttctgcggtactaaggtcaagagtagccagttgtgaacgaactatattcgatgccatttcctgtaatggcgttggtaaatctttaaattccattattagcctcgttggttagctattaacgtgggtatgtaatcattctggcaatgcttaatgccgctgctttttccagattggtgatatcctgctccagagcggacagattttcagcctgcttagccctggcttcattggcccatttcaggtcctgcaccgccttaattttctggtgcatccactcataaagttcatcatcggtatagtctggcgcgatgatgacggggtctcgtttctgcatgtcggctccttgtggttagcgttgcctgctttttaaccacgtcaggcgaggtggtatcctctgaggggtctgttactcgagaggaaattggttatgaatacaatcaagttttcttgcccagaatgtggtggctaagtctttgacacatcctttaagccgcagggctctgacagtttcgcgggagccatctgcaaaaattgtggtcaccttgtaactgaagatgagtcctcgcagttcgatgacgaaatcgttgacaatatcttcggtgcactcaccagagactttctgaagtaaaggcgcataccgcttagttaccgctctgataactcttacctgtccggcaatggcgctgatatcaatataaagcgccatcgctgtttctttgctgatccctggacgccttccattctgatgtttgactcgcccactgagaaatcctctgcttccccttaacgccgggtagcggaactgtttgctgagaacaccgtgcggtgtcttgatgagtagaatttagaatagcctaagagttatggtcaagctttttgtgtagaaaaacctaagcttcttgatgtaaaaaacacaagtatttgaaagtttgtgctttttattacagagagttgcgaaaaaaaggggggttatttatttgcgcttcttttgcgagctttgagtagttcttcaaaaagtttgttgaaattctcaactcgagcacgcatctctgacaacagagccttttgctctgactcaggcagtgcgtcgaacagttgaagcaactctttttgatcttctgtcagattgactggctgattatctgggatcggttcgcctggttgcttatcttcatctccaaaaagaagccaagtcggcgagcactgaagcgcctggctcagtgcgaataatctcttccccgctggctgtgtttcatctctttcccattgagaaattgttaccgtgagcgactttgaccagcttacctaatgcggcctgagacagttttaatttttttcgcctgtataagaggcgagcaccgaaggtttcgtttttcatattangtaattctaatttttcttgacttaggtttctctacgatctagtttccttaggaaaatctaagggtttcgatatgttgaaaattgatgctatagcgttttttggcagcaaaacaaagcttgccaatgtcgcaggagttaggctggcaagcgttgctgcatggggggaactggttcctgaaggtcgcgcgatgcgcctgcaagaggcatccggcggggaacttcagtacgaccccaaagtttatgacgaatatcgtaaggcaaagcgggcggggcggttgaacaatgaaaatcaccactgaacaggtttgtgaggctctggatacctgggtatgccgaccaggaatgacacaggagcaggcgacgatattaatcacggaagcattctgggctctgaaagaacgcccgaacatcgatgttcaacgcgtcacgtttaatgatggcgaggttgatcaacgggcgctgggcgttaaccgggtgaagatattcgaacgctggaaagctatcgacaccagagataagcgtgacaaattcacggcgctgattccggcaattatggaggctatccggatcagcgatttcagattgtattgtgaaattactgacggaaaaagcattacgtacatgatcgccgggttaaacaaagaatatggcgatgtggtggagtccgggctgctttttgcggatccagttgttgtggaacgtgagactgacgagcttatagaaaaagctattgctttcaagcacgcgtatcgtcagcaataccaatattactttgcagataaacaaatgtctgccaggggggcgtatgagtatcgatgcactacgatgggctaaaaaggtgaaaaccggcagttcatccagtaagtcagtattgacctggcttgctgatatgtgcggtgccgatttgtgtgcatacccgtctgtatctgcactggcagaagtaacggaactgaacaaaaagactgtgcaggacagcttacgacacctgatggagattgggttaattgttgataccggtgagagaaaaggcagaacaaagcaaattgtggtgtaccgacttatcggtgtagaagaaagtgttgccgagcctgaatacacccaaaaacgggagtctttaaaggtgggtaaaattggtgctgttaataaaaacagtaccgaaaatggttatgtttcagcacaaaacagacccaaaaacagaactcttagctgcatggaaaataaccaaagacacccaaattttccatcaaagacacccaaaaacggatcacggaacccaaaggaacccaaagatctaaaccccacacataacgcacgcgagagtgctccgaccagtgagcaggaagttttgtcgttacaggcagccccccctgtattcctgtatggcctgagcgaacccatcggaaaattcccgatgagcgatagctggtatccgtcacgggattttcgacgacgggctgcgttgtgggggatggctttgccggagacagaatttacacctgctgaacttgccgccttccgggactactgggcagcggaggggaaagtgtttacgcagattcagtgggagcagaaattcgcccgtcacgtaaatcacgtcagggcgcagttaaaccagtcagcaaagggtaaaccatgcagcagcaccaggtggcaccgcatcacgggcagttcaggaaattcgggcagcacgtgagcagtgggaacgtgaaaacggatttatcagcgacggaaacggcctggaagctgtgggaactcatgggggtggtttattcgaaccgctggatccagaagaacggggccgcaccttcgaagctctggattgcacagattggcgcgatgactgagcagcaaatccggcaggtctgccgccagtgcatggaccgctgccgggcgggtgaaacatggcctccggacctggctgagtttgtggcactgatttcgaaaagcggagccaatccattcggtctgacggtggatgctgtgatggaggagtaccgccgctggcgcaatgagtcctggcgatacgacggaagtgataagtacccgtggtctcagcctgtgctgtatcacatttgcctcgagatgcgttcaaaggggattgagcgccagatgaccgaaggggaattaaaacggcttgcagaacggcaactgacgaaatgggcaaagcatgttagtaacggcctgagcgttccgccagtccggcgacaactggcggcccccaaacgcccgtcggggccaacgccaattgagttgctgaaacaggaatatgaacgccggaaagcggctggttttgtttgagttgagaagtgattttttaccgggaggaaatttatggagactgtttttgacgcactgaaagcgatgggaaaagccacgtcggtatagctggctgcgcgacttgatatcagtcgtgaagaagtactgaacgagctgtgggaactgaaaaaggctggcttcgttgataaaagcgtatacacctggcgtgtggctgataacaacgttcagcaggaacagccagcgccagaagaaaccaccacggcaacagaagcgaaaatctcagagtgcgatttaaccgcgacgattgaacaacgcggaccacaaacggcggatgaactggctacgctgttcggtacaacatcccgcaaagttgcttcaacgctggcaatggcaatcagcaaaggtcgtctgattcgcgtaaaccagaacggtaaaattcgttactgcataccaggtgataatttaccagcagagccgaaagttgaatcggtagcggaaaccgatggtaaagcctttcctcagccagccggtgttgcgttaccggtacagaaagatgcaacacaggaagatattaaaacagaaactgtggcggacattgtgcagtcgctgccatcgtttactgcaacgcgagaagatgatttgattttgccatcgctgcatatggcaaatcgcgaactgcgtagggcgaagaatcatgtccagaagtgggagcgagtctgcgccgcgctgcgggagctgaacaagcaccgggatatggttgccgggatttgtcggaagtccgggcaatgagcggatggtgcaggcctgaaatcatgatactaacaatgaaggtaaaatgcatcggcagtctgattggtcgtagtgaggcggcggtcaggatgaaagcccaggttaagggaataagcctgattctgcggggtgattttcaccagtcaacaaaatatccgtagcgcgataacggtcaaaaattatggcgctgacacttttgtgccactggagatgactgtacctaagttcaggggagaagaacacgtccggtgggatggtcgggccagatttaaagggcaggtcatggctccagcctgtacgctggcaatggaggctgcctggcgggaaattgatatgggaaccacgccactcagggatttactgccggtccagagaataaattcctgttacggttacaccactgtgatcttgcaagtgcaggaaagtaggtctacacggtaacgcgagtgcgtgtaacttttgatgtcattcccgtagaaacaccggacaaattttcgctgacaggtcatgcagaaggtataaatctgcagattatggacaattacggatatccggcaagagccggaaaaagcatgccgcctctaattctcagtggaagatggacttgattatactcattgcattgtcagaaatagttatccattaaaggctggctattccaaacaggatgttgattacaaaaatgtnatcaacatgtaaggtttatactcttcaatatgcgtataattttccttattttgttgactttaaataacaagctatgcacgaggtaaagtccgataagtttatctggatgtaatatatattatttgtagtgtttataactttatttcatgataaccaataaaaggagttttttatgaggaatataatggcaggttttttaatattcctgtcttctgctgcttatgctgatatcaatctgtatggtcctggtggcccgcatacagccttgcttgatgcagccaaactttatgccgaaaaaacaggtattatagtgaacgttcattacggcccacagaacaaatggaatgaagatgccaaaaaaaatgcagatatcttgtttggcgcatcagaacaatctgctctggctatcattcgggaccataaagacagcttcagtgaaaaagatattcagcctctttatctgcgaaaaagtattttactggtaaagaaaggtaatcctaaaaatatccggagtattgacgacctgaccagacctgggattggcgtaattgttaatgatggtggtggtaccagtaatacatcaggcactggcgtctgggaagatattgccggacgtaaagggaatatagaaactgtcgccgcaatccgaaaaaatattattttatatgcgcccaatagcggaactgcacgtaaggctcttgagaatcagcctggagcagatgtctggataacctgggctgactgggcagccagtaatccagaaattggtgatgtcgtggaaatagcgccagactacgtgatatggcgtgatatgaacattacagtacgtcaggatgcaaatgatgaaacccgtcgatttgcagaatggctacaaaccgatgaagcggcgcctgcattcaaaaaatatggctggaccaggaaaggcacttgacatcctcgtccttcaggacgtggattctttttccggatgccgcgccagcggcatgtaggggcagctcacaaaacggaaaaaattgtacgctaagcctcgccaggtgaactgaattcattccgatatgggaattcccatatcgggcgaaaacggtttgctgtaacggcagagttaagtaggattgctgcgggtgcttgaggctatctgcctcgggcatgaacaccaacggcagatagataaaagccccacccgactataaatcgaagtgaggcccctatatgctcgtcacatatagattgcctcttacggaccgaaaggtcaaggagaagcaggctatgaagcagcaaaaggcgatgttaatcgccctgatcgtcatctgtttaatcgtcatagtgacggcactggtaacgaggaaagacctctgcgaggtacgaatccgaaccggccagacggaggtcgctgtcttcacagcttacgaacctgaggagtaagagaccaggcgggggagaaatccctcgccacctctgatgtgtcaggcatcctcaacgcacccgcacttaacccgcttcggcgggtttttgtttttattttcaacgcgtttgaagttccggacggcgccggaatagaatcaaaaatacttaagtagcgcgcagggagaagagggatggaccccgaacaggggagtgctatttatctggaaggattctgttgatgagaatcgaagaattacgtgaaatttttagtgaagatggcctctatactgtgcgcgttgagaagggcgctattgtcagccactgccgtattaaatgtttacagtctcaacaaaggaagagtggagctgcgttaattcattttgtggatgggcttgtgacggatggttttattttgcgtgcaaatgaatttgtcacatcgttgccgtctctgaaagaagctgggattaaggctggtttttctgcttttgaagattagtgaattcatctacaattcagcgcagggctgaacccctgttgagtaacactgtgccaccggagaaagccgatggcgcaaaattccagactacacaattctgataattcagccgtctttgccagcaggcacgggcggcgttctcatgcattcaaatctgactggttccggcacgccccatgcactgaagaacaggccgaatggctgattcagaactaccgcagacgtgggtatgagtttaggaaagccctcagcctcgattatcgtcactggataatctacgtcaggctgccgtactccgagcgcccaccgcgtccgtcccgcacattccagcaacgcatctggaggtaacgtgcgggtattacttcgacctgttccggtaccggaacttggggtggtggtccttaaaccaggccgtgaatccatgcaggtattccataaccctcgagtgcttgtggagccggagccgaaaagcatgcgcggtctgccgtccggcatcgtccctgccgttcgccagccgctggcggaggataaatcattactgccgtttttcagcaatgagcgtgtgattcgtgctgttggtggcgctggtgcactgtctgactggctgttgcgtcatgtcaaatcctgccagtggcctcatggtgactatcatcacagtgaaaccgttattcaccgttatggtaccggcgcaatggtgttgtgctggcactgcgacaaccagctgcgtgaccagacatccgaatcactcgagcaacttgctcatcaaaacctgtcagcatggatgattgacgtcatcggtcacgcaataagcggtacgcaggagcgtgaattatctctggctgaattatcctggtgggcggtccgcaatcaggtggcggacgcgctaccggaagcggtattacgtcgttcgctggggttgcgtgcggaaaaaatccgctcaatgtaccgtgaaagcgacatcgtaccgggagagcagaccgccaccatcatactgaagcagcgcacaaaaaatcttgcgccgctgcctcacgcccaccagcaaaacccaccacaggaaaagacggtggtcagcattgccgttgatccggagtctccggaatccttcatgaaacgacctaaacgtcgccgctgggtaaatgagaaatacacacgctgggtaaagacacagccgtgtgcgtgttgtggtaagccagcggacgatcctcatcatctgattggtcatggtcagggcggaatgggaacaaaatcccacgatattttcacgctaccgctgtgtcgggagcatcacaacgagcttcatgcggatccgctggcgttcgaagaaaagcatggttcccaggttgatttaatttttcgttttcttgatcacgcctttgcgactggcgtgctcgggtaaaagaggtgactgatgctcatagatttggttttaccttacccgccgacggtgaacacttactggcgacgccgtggcagcacatattttgtatcaaaagccggggagcgttatcgccgggcagtggtgcttattgttcgccagcagcgactgaaattaagcctgtccggacggctggcaataaaaattattgcagagccaccggataagcgtcgtcgtgacctggacaatattctgaaagcaccgctggatgcgctgacgcatgcgggagtgttaatggacgatgagcagtttgatgaaatcaatattgtacgtggtcagccagtatctggtggacggctgggtgtgaagatttacaaaattgagagtgagtgagcgtaaatatgatatatccggaaattacaggcaaaagcggcgaacatttacgcctgaacacgctggaagcagtctggatccaggggaaattacggatgtgggggcggtggtcgtatatcggtgggggtaaatccggaaatatgtttaaccggttactggtttcgaaaaagctgacgaaaacagcagttaatgaggttttacgcagcatgaagaaatccgggctggaaaaaccggaacttgaggcattttttcgggatatgaccagagggaagcagaagagctggttgtcacattgtacagacacagaggcgttgattattgatcgcgttatcagtgaggtgcttggggaatatcccgggctaatcaatattctccggcaaaggtacgaaggacggggaatgagtaagagaaaaatggcagaatgtttaaatcgtactcacccggaatggtgtttcagcacatgtgagaaacgtattgcaggttggttagccgtggctgaacacatgctttatgtacctatgcacgattcatttcgataaaaaaagcttgcttttttacgcagaaacagcttgaattcctgtaagcttcgcaaagctgtatcgcgaggcgaaatgcaagttttttcgcacaaggaagccaccggaaggtggtttttttgtgtccgtaatatacagcagcgcaataaattcgctggtggttattaataccgttctttcaggttgctggctttttcgacaagagttattggtgtgtcacgttaaccggaaaagggaaaaagacatgctgaaacagcaggatatgacagaaaccgccagagtggtgtttaatgaattaagcgttaccgacccggcgacagtcggggagattgcgcagaatacttacctttcacgcgaacgctgccagttaatactgacccagctggttatggcgggtctggcagactatcagtttggttgttacagacgccttcagtcctgaaggcttttttatttgtggtaaatgggcggctggtgggtgtaaggggcacccaccagccatctgctcatgcgttgggttcacaagcaaacctcaggcccactgctttgcgcaaaagcagaatgagcctatcagagacaggcttaatgatccatgcttaatactgtaaaaatatccagttgtgagttaatcaacgccgactgcctggaatttatgcggtcgttacccgaaaattctgttgacctgatagtcacggacccgccgtacttcaaagtgaaacccgagggctgggataaccagtgggcgggtgatgaagattacctgaagtggctggaccagtgtcttgcgcagttctggcgggtgctgaaacctgccggaagtcttaacctgttctgtggccatcgtctggcatctgacaccgaaatcatgatgcgtgagcggtttaacgtgctgaaccatatcatctgggcaaagccgtccggacgctggaacgggtgcaacaaggaaagcctgcgggcgtatttccccgccacagagcgcattctgttcgcagagcattatcaggggccgtatcgtccgaaagatgccgggtatgaggcgaagggtaggacactgaaacagcatgtgatggccccgctgattgcttactttcgtgatgcgcgcgctgtcctggggataacggcaaaacagattgcagatgccacaggaaagaaaaacatggtgtcgcactggttcagtgccggtcagtggcagctgccgaacgaaagcgattatctgaaattacaggcactgtttgcccgggtggcagaagagaagcatcagcggggtgaactggaaaagccccaccaccagctggtggatacgtatgcctctctgaaccgacagtatgcggagctgcagagtgaatataagcatctgcggcggtatttcggtgtgacggtgcaggtgccgtacaccgatgtgtggacgtataaaccggtgcagtactatccagggaaacatccgtgcgaaaaaccggcagaaatgttgcagcagataatcagcgcaagcagtcgtccgggagacctggttgcagatttcttcatggggtcggggtcgacagtgaaagcagcgatggcgctgggacgtcgtgcaactggcgttgaactggagactgaacgttttgagcagacggtgcgggaagtacaggatttaatcattcgtaacggatgagattgcggagttaatcatgcgtcgttattattcagcaatcggccctttagctcagcggtgagagcgagcgactcataatcgccaggtcgctggttcaaatccagcaagggccaccaaccgccactagctcatcaggaaagaacgtcaccctgtgcgagattcggagtccccggtggcggtccattatcggtattctgcgttgttagctcagccggacagagcaattgccttctaagcaatcggtcactggttcgaatccagtacaacgcaccacaccacacttatctgccctgactctcttttgcgggctttttattacaggaaagacaccggacagtgaaatgttaaatgcctcacaattcaggcagttgactgttgcctgacatgctgagcgtttgttaaaaaaatcctgcatgatgaatccccctgagcggcggggcataatgacagatgtttggttgcgtattgtataggcaagttgcggattctgtctggtcattgcagaattcaccgggaggcacccggcatcatgctgtatacagagattaggcatatatccaggcttctcatcgcaggagcctttttacatgcaaaaaaaagcccgagtgggttcgggcaacagcatgagatacttgcattgtcatttttatcgtgtggattttaaccagggtttataaggctgcgcaactgcgcggcctttttcgttttgcgggctgcggttctcctcttttgattctccttgtggccggaccgtggcccgcaactgttgaggaaaatcccggaaaggggaggaataatgacatttaaacattatgatgttgtcagggcggcgtcgccgtcagaccttgcggaaaagctgacacacaaactgaaagagggctggcaccgtttggtagtccggtggccataaccccttataccctgatgcaggtgattacagcagaaggtgatgtggtggtcagtggtgcaactgagccggattggtactacgtcatcgtactggccgggcagtccaatgccatggcttacggtgaagggcttccgctgccggattcatacgatgctccggatccgcgcattaaacagctggcgcgccgcagtacagttacgccgggtggggctgcctgcagatataacgatattattccggccgaccactgcctgcatgatgtgcaggatatgagtacgctgaatcatccgaaggcagacctgagcaaagggcagtacggctgtgtcggccagggcttacatattgccaaaaaactgcttccgtatatcccgaataacgcggggatcctgctggtaccatgctgtcgtggtggttcggcattcacccagggcgcggaggggacattcagtgcggacgcgggggccagccaggattcggcgcgctggggtgtgggtaaaccgttatatcaggacctgattgcgcgcactaaagctgcattacagaagaacccgaaaaatgtgttgctggcggtgtgctggatgcagggagagtttgacatgagcgccgccacccacgcacagcaacctgcgctgtttacagccatgctggcacagtttcgtgctgacctctccgtgtttaacgcgcagtgccatggtggcagtgctgcagatgtgccgtggatttgtggtgacacgacgtattactggaaaaatacctacggcacccagtacaacaccatttacggggcgtacaaaaacagggagagtgagggcgtttattttgtgcccttcatgacagacggtaacggcgtcaataccgccactaacgcgccggcagaagatccggatattccggcatcaggatattacggtgcggcatcgagaacgaatggaaaccaggtatcatcaaaccgcccgacacatttcagttcatgggcgcgcaggagcattattccggatcgtatggcaaccgctattctgaacgcagccgggcgcacctcagccttcatcagtggtaaggcaccggaaatcaaaccctcgcccggcggcaacacgccatcgggtccgtctgcagatacgtccgttcgcacaatctccctgctgccggcagccggagaggctgctgcgcagggctggagcattaaggatggcggaattcagttgtcagatggtgtatttaagatcaccaggcagagcaataaaacctggtccctgacgcatccggtggatgacgcaattaccctgctgacacagggcggcagactgacctgtaagttccgcctgtcaggcgcgctgaccaacaatcagttcgggctggggatttatctgtatacggatgctcccgttcctgatggtgtggcgatgacgggtaccggtaatccgttcctgatgtcgtactttactcagaccactgacggcagagtgaatctgatgcatcacaggaaagccggaaacacgaagctgggggagttcggcgattacggtaacgactggcagacgctggagctggtgttcaccgccggcagtgccacggttactccgaaactgaatggagtggctggcccggcattccaggttataaaagacagtctgacactgggactgaatgcgctgacgctgacggatgttacaaaaaatgcagcgtatggcgttgagatagaaagtctggtgctggagataaatgcaccggcagcataataaaaaaagagccagcgactgacctgaaagaagacgctggctaaaaggccttatatgtttgtagagacttatttttcacagacagcaatgatgcctgtcaatatattatcaatatgcggattgtttcagttacagatgctttattaaggaaaaaaacagccagcactgactttcggtggagaggtgctggctcagaaggatagttggatttcacatgatacttatgcctggcggtatattttctgacagacagtgacgggtgttgtcaagatattgtgtcatttataacctgaatcagggggtggccggaatgttatctggcatttttagcagagcctgaatgccataatcacggctcccggcgttggccgtcagtgggtgacactggcggcttttttgtttttctttactttcattttctgtcggcggtgacggagacatacatcagatggaaaaaatcacaacaggtgtgtcatacaccacgtcagcggtggggacgggatantngttactgcagctgntggacaaagtctctccntcccantgggtggcgataggcgtgctggggagtctgctgtttgggctgntgacatatctgacgaacctgtatttcaagattaaagaagaccggcgtaaggcggcgcggggagagtaaagtgatgaagaaaaaatacgaactggttgttaaagggataaataattacccggataagattactgttactgtggcaccggaaattggtgggtatccgtcactgttgttgccagatgtggcgattagtcttgaccgtactgaaggtgccacgctggagttttacgaagctgaggcgaaaaagcaggcgaagcagtttttcatggatgttgctgccgggttatgtgaaggggatggtccgttgccggaaaagcgccccgtaattttagaggcgcaggatgtgttgataacctacagaggaaaactaccgggaataattacgggttctctgaagactccaccgctggcctgaagacttaacatatccagggatttgaaatcgataaaccctgataaatatccatgaacgcaaaaatcagatacggcctgtcggctgccgttctggcgctgattggtgcaggggcgtctgcgcctgaaatcctcgaccagtttctggatgaaaaggaaggtaaccacaccacagcataccgtgatggtgcgggtatctggaccatctgccgtggagccacccggggggatggtaagcctgttattcctggcatgaagctgtcgaaggaaaaatgcgaccgggttaacgccattgagcgtgataaggcgctggcatgggtggagaaaaacatcagagtgccactgaccgaaccccagaaagcggggattgcgtcattctgtccgtacaacattggccccggtaagtgtttcccgtcgacgttttataaacgaattaatgcaggagatcgaaaaggtgcctgcgaagcgattcgctggtggattaaggacggtggcagagactgccgtattcgctcaaataactgttatggtcaggtatcccgtcgtgaccaggagagcgcgctggcgtgctggggaatcgacagataagcagaatattttgctgaaaaatgacgttggccagcgcgggcggataacacgaaatcctgcgaactggcaaaatgtaagtgaataaagttaggcagattatttcacgcagaggcaccgtaatggtgcctttgtcatttctgcgcttcgcacaagcgtaaataaaccaaagaacctttcaggatgagccctggtggataaccggcagtggtctggttaaccctctttgggctggttattcctgtgcgcagggttcatcactaaaaggaatcaaccatgaaagagatgatttctgtcgatcatgaaatatccatgagtagtctggattttctgaataacattattaatccagcccgggcagaagccggagaagtccctcatgaaccgcgtaagtttcttgcaaaaattgaggatgagctagagcttgatggaaccggaaaaaaattccggttaaacaataaccagacaagaacggcatactatgatctggattttgaccagatgatgctcgttggcatgagggagtcaaaggccgttcgtcgttctgtgctggcaagactcaaagcgatgcatggtattcagatcccccggactttacctgaggcgttgcgatttgcggcaaaactggctgaacagaaagcagtgctggaaaatcaactggcaatagcagcgccgaaggctgaatttgttgataactatgttgaagcatctggtctgatgggattccgggaagttgctaagttactcggtatcaaagaaaccgatttccggctgtttttgttggagaacggaataatgtatcgcctcgctggaaaaatgacgccttactcgcatcacctggatgcggggcggtttagcgtgaaaacgggcgaggcgggcaatggtcatgcttttacgcaggttaaattcaccccaaaaggtgttcagtggattgctggtctgcttgctgcatggagagctaccgcagcatgaagatgataaaaacggactggaaatttttgctggtctggctgattccgtttttatgggtggttgcccggttaattactgctattaaggggtaaagatgtcagacaaactcataatgctggcgaagggcctttgtgtaatcgtcggtatttcattttcactaatgctggttgttctttttctttccataacctggatggcgttgacttcggcagggctggtggggtgagcataaaccgaatgctttccgcgtttaccgttattctgctggtggtctgtggtgcgcttagtctggggctgaatcattaccgcgataacgtcatcacctacaaagcgcagcgcgataaaaaagccagagagctggagctggcaaacgcaaccattactgatatgcaggtgcgccagcgcgatgttgctgcgctcgatgcaaaatactcgagggaattagccgatgcgagagctgaaaatgaaactctgcgtgctgatgttgccgctggtcgtaagcgcctgcggatcaacgccacctgctccggtaccgtgcgtgaagccaccggcacctccggcgtggataatgcaaccgtcccccgactggcagacaccgctgaacgggattatttcatcctcagagaacggttgatgacaatgcagaagcagctggaaggggcacaggactatatccgcactcagtgcctgaactaagttttgctgatgcgccgtatcgtcgctgtattccctcattaacagagaccgcagcccgacagggagactcctctgcgcgagtgtgcggggagaatcaaaaacgatacgcaccggggtttaccgcgttaacggagcgcggcgttgtcccctcatggtcgctggttcggtgcgatggtggaagaaaccggacgatgtgttacctcgcaagacctgttatgtcatgtgtctgatttgtgatttaagtcggataattgtcgttgccattaagcagaggattgatggccgacagggtggcattgttagaataagacttattcttatctgtgccgggaatgaaaatgaaaagaaatcttccgttaattattttgttgtcttctctggttatgggctgtacgcaacataaaacagatatgccccgacagttggttaaggcattaccacaatatccggcctatgcagcggcaaattatataaagggacgggttgatgtgaagtttgatattggtgctgatggtactgtcacccgaattgagtttatccgttcagagccgcaccatctgtttgatgagcaggttgtaaaggcgatggcaaaatggcgatttgagaaggacaggccgcgtaaaggcgtgaagaaaacgtttatctttagtccttctgcaccctgattatttcatcagaaattaattatcactctgttgttattctgtacattccggctgggtaagtcttgttccgccgggtatgaagatgaaatattgttggaggacagtgggtacctgctcctgtaaccgaacgttcatttctcgttatttgtcatgctggccggacgcagatgcgttgcatctgttgccagccttctcctgcaggcttcaataacccacgctgaaaagttaccggaacctttatgttcaagggcgatattgatctgttcaatcatgtgattggggaaacggatattgcgggttgtggttctgcgggtccggtttttcgatgacatatttatttcctttactgattgccatatgacggggattttacatggctgagcttcgtacactccagagcagaatcaaaacactgaatacccgacgggtgaatattctgaagggtgaacagcgtcgtgtcagtggcagtgcacgtgtttccctcaagcgtcatatctggctcagggatgccgggcagtgctgtctctgtggtcgtgtggttgacctctgtgacagtgaactcgatcaccgaattgcacttcagttcggtggtggtaatgaggagacgaatctctggacgctctgtaccgaatgccatcgacaaaagtctgctcgtgaagcggcgggtggtatgccggacccgacgctgccggaggtgtccggaggtagtggcagagcggacgacatcatcggactgtaacccgagcgggggggtatcatccggcgtaaaaaacgatcgctccggacaccgcgccccctctcacgcagagaaaaaattcccgtttcagggcagttaacatgttaactggctgtccgggcatttttgcggtttttatctttattattcagtttgttgtgcgaaaaaaatgttaactggctttttcatcaaatgttaaccaggcagcagttaacatttgcggcatgagacgccgggaaaaatgggctgaaccatacccggctgagtgcgttctggacccgggaggaggctgtgctgacaacgcaaaaacgaaaatttgcgctggcgctcatgtccgggaaaaacaaaacagcgtcagccattgccgctggttattcggcgaagaccgccagggttaaaggctcgcagctggcaaaagatccggaggtgcttgcgtttatagcccgtaaacaatgcgagacggtggaggtggatgaggttcctgtttaccggcagaaaaaatcagagcaggaggataaaccccgtcgccgtgaggcggctgcaataccacagccggacgaaaacaatccggagatgccaccgtccgcggtgatgtctcctggtattgaatatatggaggatggtcttcccgatccggtgaaagcgatggggcgtcttctggtggagaacattaataccgaccccaggctggcgctggatgcggcttataagctggcgcagttcacgcaccataaaaaaggggatgccggtaaaaaatcggcaaaaggtgacgcggcgaaaaaagcggctaaccgttttgcggtgccaccaccaccccgcctggtggtgaataatgataatgagggcaacggatgatacctgtgtggagcacggcctgcccggactgggcagagcgcntgaaaaaggggctgtcgattattccggttccgatttatccggaccaggtgcacatgcactggcgatttttaaacaactgcgaattgtggatgcaccgggtagcccgacattcggggagtcctgtgcaccgtgggtgtttgacctggtggcggccctgtttggctcctacgatgcgcagaccggtgttcgccatatcaaggaagtgtttatccttatccccaagaaaaactcgaagtccacgctggctgcggggatcatgatgacggcgctgttactgaactggcggcaggcggcgggctacaccattctggccccgaccgtggaggtggcggctaacgccttcaaccctgccagggatatggtacgacgggacgatgatctggatgacctctgtcaggtgcagacacatatccggaccatcacccatcgggtgacggacaccaccctgaaggtggtggcagccgatccgaatacggtgtccggtatcaagtccgtggggactctgattgatgaactgtggctgtttggcaagcagtacaaggcggaagacatgctacgtgaagccatcggcgggcttgcctcccgtccggaagggtttgtggtgtatacgaccacccagtcgaatgaaccgcccgccggggtgttcagacagaaactgcagtatgcccgggatgtgcgcgacggcaaaattcatgatccgcactttctgccggtgatttttgagcatcctcctgaaatggtggaaagcggggctcacctgctgatggaaaacctcgccatggttaacccgaatctcggttattcggtggatgaggcctttctgtaccgggagtaccgtaaagcccgggaggctggtgaggaagcatttcgtggcttcatgtcaaaacacgccaatgtggaaatcggtcttgccctgcgttctgaccgctgggcgggcgcggatttctgggagcagcagggcaggcgcgtcagcctggacgatatcctgcagcgcgctgatgtggtgacggtggggattgacggcgggggcctggatgatctgctgggaatgtacgtgactggccgtgacagggaaacccgcgaatggctgggctggggccatgcctgggtgcatgaaaccgcggtggtcagacggaagagtgaggcatcccggtttcaggattttgtggcctgtggagacatgacgattgtccgtcgggtcggggatgacacggcggaagtggcggagtatgtgcgtcgcattcatgaggctgagttactggatcatatcggtattgacccgtcaggtgtggggcagattctggattcactggcggaagccgggatccccgatgagagtgtggtggggataagccagggctggaagctgggcggggccatcaaaaccaccgagcgcaaactggctgaaggggtgctgattcacggtgatcagcccctgatggcctggtgtgtcggtaatgcccgggtggagcctaaaggtaacgccattcttatcaccaaacaggccagcggacggggaaaaattgacccgctgatggcgctgttcaatgcggtctccctgatgtcccttaacccggaaccgaaaaagaaagaatatgcggtttttttcatataaccctgttcacactgtaaccatcacgaaccgctccggcggtttttttattttcaggaggctgatgtgactcttaaacgggcctgttccctgctgacggtgaaatccttcagtgaggatgaacgggtgatcaccgggattgcgtcaacgccttctccggatcgggatggtgacatcctggagccggagggcgcggagtttggcagtgcgatcccgtttctctggcagcatgaccattcccgcccggtggggcagtgtacggtacgccgggtcagcgaagggctggaaatcacggcaacactggtgaagcccgtaccggatatgccgtcgcaactggctgcccggctggatgaggtctgggcggccattaagaccgggctggtcagggggctgtccgtgggcttccgtccccatgaatacacctttctggacggaggcggactgcattttctgcgctgggaactgatggaggtgtctgccgtcaccgtgcccgcgaatgcggaatgcaccatccggaccattaaatcttacgaccgcccgttttctgccgcgtccggcaaccggaaaccggtggtgaaaatcgcatcttctgccggcgctgcggcacagtcaacaaccgtttttcataaggaaaagaccataatgaatattggcgaacagattaaaagttttgaaaacaagcgtgcagcgctggcagcctcccttgaggaggtcatgaccaaagccgcagaggaagggcgcacgctggatgtggaggaggaagagcactacgacaacaccgcagcggaaatccgtcaggtggatgcgcacctgaagcgcctgcgtgaactggaagccggtaaggccgccacggcgcagccggtgaaacaggccggtaacgggaatgtggccgcggtggnttntgcgccggtgatccgtgtggagcagaaactggataaggggattggcttcgcccgctttgccaaatcgctggctgcggctaaaggcgtccgatctgaagccctggaagtggcccgccgtcagtatccggatgacagtcgtctgcatcatgtcctgaaatcggcagtgggcgcggggaccaccacggatccgcagtgggcaggcagcctgtctgaatatcaggaatacgcacaggactttattgattacctgcgtccgcagaccattatcgggcgatttggtcagggcgggatccctgcacttcgtcaggtgccattcaatatccgtgtgcacgcccaggtgtccggcggtgctgccggctgggtgggtgagggtaaggcaaaacccctgacgaagtttgattttgaatccatcaccttcagtcatgcgaaggtgtcggccattgcggtactgacggaagaattgatccgtttttccagtccggctgctgatgcactggtccgtaatgcgctggcggaagcggtggtggcgcgtctggatacagactttgtggacccgaaaaaagccgcagtggcagatgtctccccggcgtccatcacccatgatgtgaagggcacggcatcaaccggtaacccggatgcggatgcagaagctgcgtttggacaatttgtggcaccaaacctgcagcccaccggtgcggtctggctgatgtccacaccaatgccctggcactgtccatgcgtaaaaatgcgctgggtcagaaggaatacccggacatgaccctgctgggtggctccttccaggggctgccggtgattgtctcccagtacgtgggtgaccagctggtgctggtgaatgccccggatatttatctggcggatgacggcggcgtggcagtggatatgtcccgtgaagcatcactggaaatgcagtctgagccgaccggcgacagtaccacgccgtccccggtggagctggtttccatgttccagacaggcagcgtggccatccgtgcggagcgctggatcaactggcgtcgtcgccgtaccgcggcggtggcggtgatcaccggagtgaactacggcagtgcgtccggcggctgagtctgatgaggagggcgggaggcgcgagcttcccgcagtaacagatggcaaaaatccagtatctgcagggcacgcatgatgcccgggccggggatatccgtgatgtggcacagccgtgtgcggaggtgctggttcgcctggggaaggcggagtacatcacagcgcgacgtccggcaggtcagaaaaagaaacgtgangcggagcatggngaatgtggaaccttttgcggcgaacccgaaaaaaccagaaatcaggacgtgacgtaagagaagtgggntggcggtccctgtttcaggcggtggntgagccttttgccggtgcctggcagcagggggtgaaagccgatccggaaaccgttttgtcctttcacgcggtgttttcatgcatttcgctgatatcccaggatattgccaaaatgcggcttcgcntgatgcagactgatgtacagggaatacgccgggaaaagcggcagggagatantgcccgtntctgtngtcgtcntaatgcgcagcagaatcgcatccagttttttgaactgtggctgaattccaaattgcgtcacggcaatacggtggtgctgaaaatccgcaccccccgggggcagatcaaagaactgcgtattctggactggaaccgggttgaacctctggtggcggatgacggcgaggtgttctaccgcatcacgccggaccggaactgtgggatcacagagtcggtgacggtgcctgcccgggaggtgatccacgaccgttttaactgtttttttcatccgcttgtggggctgccgccggtgtatgccgcaggactggccgccatgcaggggcatcatattcaggcaaattcgacgtattttttcagaaatggcgggcgaccatcaggcgtgattgaggtccccggcagtattacggaagaaaacgcgaaaaaattgaaggggaattgggacagcggatatacgggcgaaaatgccgggaagacggccatattgagcaacggggcaaaatacagccccacgatgttttcaccggtggatgcgcagacggtggaacaactgaaaatgacggctgaaattgtctgttcggtgttccgtgtcccggcctacaagattggcgttggccacccgccttccagtgacaacgtggaggcgctggagcagcagtattattcccagtgtctgcagacgctgattgagtccattgaactgttactggatgaggcgctggaaacgggggaaaacgagagtacagaatttgatgtcaccacgctgctgagaatggacagtgagcggcgcatgaaaacgctgggggatgcggtgaaaaatacgcttctcacgcccaatgaggcccgtaaacgggagaacctgccgcccctggccggcggtgatgcactgtatcttcagcagcagaactacagtctggaggcgctgtcccgtcgtgatgcccgtgaggatccgttcgcgtctgccgggaaaacagtttcatcacagctgcctgacggcgcatctgacggtaataaggcaatcagtgaaacagagcatgatgcggtgaaagcgatgttcaggggggatactgagaaaatgacggaacgggaactgtccattattcgtgcactgggagaagaattttccacagtgctggcggatttacagcgcacatttgaggggaagatggcctcgcaggcacaagcgtttgaagagaaactgacttccctgtcggcggtattacagaagcatgtgacggtggatgaggtgcgtccggttctgcaggcgatggtggatgacgctgtgggggccattccggtaccgcgtgatggtcgtgattatgatccggatgtactgcagcaggcggtgaatgatgcggtcgcaaatattccgcagccggcggacggtaaaagtctcaccccggatgatgtgcgtccgatgcttgaacagatggtgaaggaggctgtaagccatatccctgttccgcgtgatggtcgtgactacgatccggaagtactgcagaaggcggtgaatgatgcggtcgcaaatattccgcagccggcggacggtaaaagtctcaccccggatgatgtgcgtccgatgcttgaacagatggtgaaggaggcggtaagccatatccctgttccgcgcgacggtcgtgactatgatccggaagtactgcagaaggcggtgaatgatgcggtcgcaaatattccgcagccggcagacggtaaaagtctcaccccggatgatgtgcgtccgatgcttgaacagatggtgaaggaggcggtaagccatattcctgttccgcgtgatggtcgtgactacgatccggatgttctgcagaaggcggttctggatgcggtgagtgccctgccggctccgcaggacgggcgtgatgccacggcactggaaatactccccgccattgacgatcaaaaatcctttccccggggcacgtatgccacacaccagggcggactctggcgggcgtatgaaaaaacgcacgggatgcggggatgggaatgcctggttgacggggtggcggatattgacgtcagcatgacgggtgagcggttgttctctgtggtggtccggcagagcagtggccagcgtacggaaaaaacattttccctgccggtgatgctctaccgcggtgtgttcagagccggtgaaacctaccaccccggcgatacggtgacgtgggggggctcgctgtggcactgcaacagtatgaccgaagataaacccggagaagctcattcatcagcctggaccctggctgcaaaacgtgggcgggatgcaggaggctgaaaatgacggcattactgacactggaagagatcaaggcacatctgcgtgtcgaccatgacgcggatgatgacatgctgatggacaaggttcgtcaggctaccgccgtgctgctggcctacattcagggcagccgggataaggtgattcgtgaggacggtgaactgatcccgggcgaggcattaacccggatgaagggggctgccatgcgactgaccgggatgctgtaccggaatccggatcttgcggagcgggaagaactgattcagggggagctgccgttttctgtttccgtgctgatttacgatttgcgttgtccgacggtgttatgaggagggggaatggcaatatctgcaggtcgtctgacacagatgataagtgttctgaacccggtgttaacccgtaacgctgccggagaaatgacggaagaatgggtgtcatgcgggaaaattcatgcggatatccgtggcaggagcagccgggagcggatgcagtccggtgcgcaaatggcgcaggcggaaatccgcatctgggtgcgcggtcagtccggccgggaaatcacggcagcgtcacgacttcatgtgctgagtggtccatggcgtgaccggatcctgaacgttgtcgggctgcccgtgccggatgcgaccggcggacgtctggaaattctctgtcggctgggaggggaaaaatgatcgaaaccctgctggatttttcggggctggaggacatcagccgcgatttgcagcttctgagtggtgcagaaaataaccgggtgctgcgtgaggcaacccgtgcgggtgcgaatgtgctgaaagaanaagtggtgtcacgggcaccggtacgcaggggaaaactgcgccgcaatgtggtggtcctttcccggcgctcccgcgatggcgggatggaatccggtgtgcatatccggggtgttaatccggacaccggtaacagcgataacaccatgaaggcggataacccgcgcaacgctttatactggcggtttgtggaaatggggaccgtgaatatgccaccgcacccgtttgtgcgcccggcatttgatgtgcgcagtgaacaggcggcacaggtggcgattgcgcggatgaaccgggccattgatgaggtactgagacgatgacggaggcggatttgtatcctcatctggcgcatcttgccggcgggcaggtgtacccgtatgtggtccccctgctggatggcaggccgtcggtggcgcttccgtgggtggttttcagcctgatttcatcggtgtcagcggacgtgatgggcgggcaggcggagtcctcagtgtcggtgcagatagacgtttatgccgggactgtgacgcaggcgcgtcagatacgtcaggacgcccgtgaagccataatgctgctggccccgggatccgtcagtgaaatgcaggactatattccggaaaaccgctgttaccgtgcaaccctggagtttcaggtcacggtgtgactttttcttttttctacaaaacccataccccgccgcgtgcgggttttttattatcaggaggcagaatgtctgctttgtatgaacgctcacagctgacgcaggtgatgatttcatctgccccggcgactgctgaaactatggataaggcggaatatctgcgcctggactgcaccatcaaggaagtgcagttcaccgccgggcagaaacaggatattgatgtgaccacgctctgctccacagagcaggagaacatcaatggtctgggggcgtcgtctgagatttccatgtcgggcaatttttatctgaatcaggcccagaacgccctgcgtgatgcctatgacaatgacgcgttgtatgcgtttaaggtgctgtttccgtccggtaagggctttaaattcctggcggaagtgcgccagcacacctggtcatccggtaccaacggcgtggtggctgcaacgttctcactgcgtctgaaaggcaaaccggtgtcctttgtggtaccgctggcgtttgtgaaanatctggataagacacttaccgtgaataccggtgcgctgctgacaatgtcagtcagtgccaacgggggaacgccgccgtataaatacgcctggaagaaggatggtcanccggttgacgggcntacnacagacaccttcagtnngccaggtgcgcagtccgctgatgcggggaantatacctgtgtggtgaccgattcggctgaganagcacagagtgtgacgtctgttgaatgcaccgtgacagtgagcgcngccgccggatanggggatgggtcatcatgaaaaaggatctgaaancgctggcgctggccacactgtcagggtttcgtcatnanacagtgaaggtgccggaatggggtnntgtcnncntggtgctgcgggagccttcggcagaggcctggtatctgtggcnngaagtgctcaatggtgatggagaggatgacgataccctgtcggtggtggcganaacccgccgtnaacctggaagcggatgtgncgctgttctgcgatgtcctgtgtgatacggacctgcagcgggtgttctctccggacnaccgtgagcaggtgctggccgtctatggtccggtacatgcccggttgctgcgtcaggcactggaactgatcgctgatgcagagtcggccagaaaaaagtagcccgcccggaaattcgctttctgatgcgacttgcgctccgtctggggcgcaccttatccgaactgcgccacagcctgagtgcgagcgaggcgatgatgtggatggagttcgacagggtatccccgctgggtgatnagcgngnngatatctgtaatgcacagatcgtgaaagcggttttcggngcacaggggatgaatgttncnctgaaggacgccatgctctgctggggcgaggatgaggataagccggaggtggatccgtttgcggcgntggaagacgcgctgagccttgcagcacagtcatgaatgatgagaaccgctgaggcggtttttttacgcccggagaaaggtgaatggcgacgttacgtgaactgattatcaaaatttcggcaaattcacagtcattccagtcggagatccagcgggcgtcccgtatgggcagtgaatattaccggaccntgcagaatggcggacgtcaggctgctgcggcagccagggagcagcgccgggctctggctgagctgcacagccagttgacggaaatccgcgcttcggctgtcggaatgaccggtgcgtttgccggtgcctttgccaccggacacctgatttcgctggcggatgaatggagctccgtgaatgcccgtctgaaacaggcatcacagtcatccgatgaatttgcgtcatcacagaaagtgctgatggatatcagccagcggacaggcaccgcattttcggataatgcggccctgtttgcccgttcggctgcctcgatgcgtgaatatggttacagtgctgatgatgtgctgaaggtgacggaggccatttcgacagggctgaaaatctccggtgccagtacggcagaggcgggctcggtgatcacccagttcagtcaggcgctggcgcagggtgtattgcgtggtgaggagtttaattcggtcaatgaaagtggtgaccggatcgtacgtgcactggctgcgggtatgggcgtggcccgtaaagatctgaaggcaatggcggatgacggaaaactgacagcggataaagtggtccccgcgttaatcagccagctggggatattacgtgatgaatatgcggccatgccggaaacggtttccagtagtatcacaaaggtggaaaacgcctttatggcctgggtgggcggtgcgaatgaggccagcggggtgacaaaaacgctctccggcatgctgaacggtgttgccggacagattgataatgtggcaacagccgtgggcgcgctggttgccgtcggggttgcccggtactttggcaatatggcctccggagcgatgtctgccacggcaggacttgtgacggctgcacgtaatgaagttgcactggcggaagcacagttcaggggaacgcagattgccacggcgcgggcaagggcagccgtgtaccgtgctcagcaggccgtggcggcagcccgcgggacggagatgcagattgctgcagaggcccgtctggcggccacacaggaacgcctgaacagaaatattgctgccagaagcgccgcccagaatgcgctgaacagtacaacggcggtgggctcacgtctgatgagcggtgcgctggggctggttggtggcgtacccggactggtgatgctgggggctgcagcatggtacacgctgtaccagaatcaggagcaggccagggagtctgcgcgccagtatgcactgacgatagatgaaatcgcgcataaaacgccgtcaatgtctttgcctgaagcctcagataatgaaggacgaacacgggcggcgctgacagagcagaaccggctgattgatgaacaggccagtcgggtgaaatccctgcaggaaaaagcgcagtccattcaggatgtgcttgccgggctggaagaccgtcgtgtggcgttaattcgtcagcaggcggcagagcagaataaggtgtaccagtccatgctggttatgaacggtcagcatacggaattcaaccgtctgctggggctggggaatgaactgcttcagcagcgtcagggactggtgaatgtaccgttacggctgccgcaggccaccctggatgataaacagcagagtgccctgacaaaaacagagcgtgagctggccctgtccagactgaaaggggaagaaaaagagcgtgtccgactggggtatgcggcggatgacctcggttttgtgggtgatccgtatcaggaggcgagacaacgttatatcagtaatgccctggaagcctggcgcaataacgaggcgaataaacccaaatcccggggtggaaaatcagagacggaaaaagcggaagacagtttttcccggctgctgaagcagcagaaagagcaactggcactggtggggcagaatacagagctggcgaagctgaaataccagacagcgctgggtgaactgaaaaccctgacggagatgcagaagcaggaactgctgcgtaacgcgaccctgattgaccagcaaaaaatccgggaacagttgcgatcccgggaagagacactgaagaatgagaatgcggctgcgcgtgcgtcgaatgatgctgaactgctggggtacgggcagggggagcgagccagagaacgcatgcgggagttgcagcagatccgcgacagcttccgccagaaggatgcggaccttcagtctcagtatcagaccggggatatcagtgaggatttttacagacaggntctggcacagaacgcgcagtatctgagcgaacgccttaaggaccaggcagtcttttatgccgaatcggatgtgcagcgtgcggactggcagaaagggctgcaggagggattcagtaactgggtggataatgcgtccgattacgcctcacaggcagcacagctggcgacggagggtatctcagggatggtgaataacatcacggagatgctgaacggaaataaagtggaatggcgcagctgggcctcatcagtgctgcaggaaatatcaaaagttcttatgaatgccgcgattgtcaacggaattaagacggcggcaaacggtatgtccggtgcgggaggatttctcggcagcattggtgactggctgggcggagcggtggccaatgcaaaaggcggcgtgtatacctcggcaaacctgagcgcgtacagcaacagcattgtggacacgcccacgtactttgcgtttgcaaaaggggccgggctgatgggggaagccggacctgaagctattatgcccctgacccgggcggcggatggctcgctgggcgtacgcgccgtgggcagtatgaacggcagtgctggtctggtgtattccccggtctaccacatcgccattcagaatgacggggctaacggacagatagggccggaggcggcaggcagtcttgtgcagctgattgaccagcgggtgcaggcggtgatgctgtccatgcgacgtgacggaggaatgctgagtggctgagataaaaacgctgcatctggtcccgcgtgaagggatgcaggtgagtgagaanccgtcngtggtgagggtgcggtttggtgacggttatgaacagcgccgccccacagggctgaatcctcaactgaagacgtttcaggcggtgttccgggtgacggatgagtcaacccggcgctggctggatgaatttttatcctggcatggtggttaccgtgcctttttgtggcgaccgccgaaacataaccggacggtgagggttgtgtgccgggagtggagcgtcacggataacgcccggtacagtgatttcagctgtacgattgagcaggtggtgaactgatgcaggacattcatgaagaaagtctgaacgagtcggttaaatcagagcagtcaccgcgggtggtgctctgggaaattgacctgacggtgcagggcggtgagcggtattttttctgtaatgagctgaatgaaaaaggggaggcggtcacctggcaggggcgggaatatcaggcatacccgattgacggcagcggttttgagatgaacgggaagggcagcagtgcccgcccgtcactgacggtgtccaatctgttcggtctggtcaccggaatggcggaggacctgcagagcctggtgggggccacggtggtccgccgccgggtgtatgcccgttttctggatgcggtgaattttgtggcgggcggtcgtggttatcgggcggcagaggtaaaaagaataaaaaaatcccgcagagttgcggggacagacaaagattaacgttaaggagttatttttgtttctggtgctcgggcaaaaaaacattaacgcagagaaattattagcaccacagtcagtttgtgaaaatgtgaagatattcagaagttttattcantcatgatacaggcatcctccgggatgcctgttgtttttgtgcgtaacanttatcacagtaaagggtgagacaatgggcaaaggtggcggcaaggcgcacacgccggtagaggcaaaggacaatcttaagtccacgcagatgatgagcgtgattgatgccattggtgaanggccgattgaaaggtccggtgaaa

SEQ ID NO: 80 - DNA  (genomic), 354 bp; double-stranded, linear
ataaaattgaaagtatgtgcatttaatgtggagcatgcacaattgcaagtgccagagagcttacgaacatgccctgttacattatgtgaaccagaagatggggtatttatgaggaattcaatgaattcaaatgtttgtatgttgtatgataaaatgtcattaatatatcttgttaaaacaagggcggctcatcctttgagcagggaatcaatcgcagtttcaatgattgtaggaagagataattgtgcttttgactctgacagaggtaacttcgttttaaaaaattaagatagcaatggcgggttaacttttcgtaaaatgaaattaattctcggtacagcatgtaaaacgcgg

SEQ ID NO: 81 - DNA  (genomic), 205 bp; double-stranded, linear
cgtcagcagactcccaggtatctttcagcgtctcctgaacaaaagtttttgcagaatctttatcggcggtgcgagtaactgaaaggccatcgttgctggtggatttgatgatcacttctacatcgtcataacgtttactgacacgtcgcagcatttcttgttgcagggcaggaacagaaccttttggcattttgttgattttggc

SEQ ID NO: 82 - DNA  (genomic), 1494 bp; double-stranded, linear
atggggaacggctgtttttgcgatattgcgaaggagataataaaaaacgttggtgaaagtgatgacgcaataacgctgaattgccaaaacccgtcagctcggcaattttctcgatgttaaaaaccgaattttgcagataatcctgtactcgtattaagcgctcattgagcagccagcgggcgggcgtcatgccagttaacgcctcaaaacgtcttaaaaaagtgcgcggactcatatttacccgttcggcgagggaagacacagtatgtgtttgtgccagattctgctgcaaaaagtcgaataaggcacctaacgtctggctttcacgcggtgaggccattgggcgcgtcagattttgtggttgatccccctggcgatgtggctgaatgaccagtcgccgggcgacattattagcaatctcatgaccaaaatctttgcgcacgatatgtaaacacagatcgatccccgcggcgcttccggcggaggtcatcacttgtccttcatcctgatataacacattgtcacttacgctgattgaagggtaacggtgctggagttgttcagtgtagcgccagtgggtggttgcttttcgctgatgaagaaggcccgcagcagcaaggacaaacacgccagagcatattgataccaggcgagtaccgcgctggtgtgcctcgcgcaatgactggcatagcatctccggcactttggcatctattccgcgccagccaggaataataatcatatcggcgttgggcaataactccagtccaccatcagcaaccacgtggatccccccggtggcttgtagcgcacctggttctaccgcagcaacagcaaaacgataccagttatcgcccagttccggtcgtggcaggccgaatatttcaacggcaacgccaaattcaaaagtacatagcccgtcatatgccagtgcaatgaccagcggacgttgtaacgttgtcatcattttgctcatttctggcatatcgagaggcggtcagtgaaaggtagattagttacattattgttaacacaacaaaccaaaaggacaaagcaatatgcgttatgtcactgaatttaccacagcgaagccagaagttgctgaggcgcattttctcgcgcgcttgagtgtcgaaacagattgcgccgatgttcatgactctctggcttatattggcgatgatttcgttttacttcatgtggttggacgtgaagaggacttcgcgcgtcggcatatcccaggcgctctccatttaccccataagcaaatgaccgcagaaagaatggccgaatggcccgacgatacgctatttgtggtgtattgcgcggggccacattgtaacggtgcagaccgtgcggcactcaaactggctcgactcggaaagccggttaaaatcatgctcggcgggataaccggctgggaagatgaaggctatgcctttgcctcagaataatgattagcgaagccgtgccagtagtggaacggcacgaacg

SEQ ID NO: 83 - DNA  (genomic), 498 bp; double-stranded, linear
ctttatgagaatttacttattacgttgagataattgccacccgcaattgtatggacagataattaatgcatgtacaccccatttcaactttccgtgtgttccaggaaggtcatctgctacgtaatagcatcgctatttttgcgctaaccacgctgttctattttattggtgcagagttacggctggttcacgaactttctcttttctggccgctgaatggcgtaatggcgggggtgtttgcccgctatgtctggcttaatcgactgcattactatgcgatcagttatgtggcgatgctggtttatgatgccataaccaccgaatggggactggtttcactggctatcaatttctccaatatgatgtttattgttaccgtcgccttactggtcgtgcgggataagcgtttggggaaaaataaatatgagccagtaagtgccttacggctatttaattactgtctgattgccgcattattatgcgctattgtcggggcga

SEQ ID NO: 84 - DNA  (genomic), 124 bp; double-stranded, linear
acggatataggctggctggtatgccgatttgccgtttgccgcatcttcccagcgttgaagactcaagctggcaaaccgcgtgcaaatgagcacgccctctttccatcaacacttcaggcagctt

SEQ ID NO: 85 - DNA  (genomic), 3281 bp; double-stranded, linear
attaggtgtccttgtgatttaaagatattatcgttcttcgtgaaatgtaataaccctggaaactatattctcagggcaacaaccaatcaagaatgattcttgttttataagcaataacagaatgacttaattgttaactctctttattcagctacttaaatataaattttggagaattatgaaactcaaacatgttggtatgattgtcgtttctgtgttggcgatgtcgtctgctgcggtaagcgcagccgagggtgatgaatcagtaacgaccactgttaatggcggtgttattcattttaaaggtgaagtggtaaatgccgcttgtgcgattgattccgaatcaatgaaccaaacggttgagctgggtcaggttcgttcttctcgcctggctaaagcgggtgacctcagctccgccgttggcttcaatatcaagctgaatgattgtgataccaatgtttccagtaatgcagctgttgcattcctgggtactactgtcaccagtaatgacgatacgttagcgctgcagagttcagcggcaggctctgcccaaaatgtcggtattcaaattttggaccgtacgggtgaggtattaatacttgatggggccacttttagtgctaaaaccgacttgattgatggcacgaatatactaccattccaggctcgttatattgctctcgggcagtccgtagctggtactgcaaacgcagatgcgaccttcaaagttcaatatctataattcaatattaaggtggctatacggcatctgaaattaaaacagggtgtgtgtggcatggctacgcacacccgagcaattcaccaatgtgaatctcattattaatgatgagtggtttgtatttggagcgctatgaaaaatcacataatatctaaacgttcaataaacaacagtagttaaacttactgttattaaaaatatttactttttagcaaggttttcctattaaaagagaaccaacctttattacaaacgcattaagtctggaaacccggtgactcgccaatgtattagcaacatttaccgattgtctgatgtaacggttttcccgcttatcctcttaacacatgggagaatgcatcagatgcaaactacgcgtaccccctactctatttcctttatggcgacagtgttacttttattgctctttgcttgccatagcaccgttgccaacgcagctgtcgcactgggtgcgacgcgggtaatttatccggcaaaccagaaacaggttttattgcctgtcacgaataatgatcctgccagtgtctatctcattcagtcatggatagaaaatgctggtgaccaaaaagacacccagtttgtcattaccccacctcttttttccatgcaaggtaaaaaagagaatacgctgcggataatcaacgccactaatcatcagttacccggcgaccgtgaaagcctgttctgggttaatgttaaagctattcctgctatggaaaaagaccagaagaatgagaatacattacagctggcaattattagccgcataaaaatgttttatcggcccacgaacctggcaatggcacctgaagaagcgcctgcaatgcttcggtttcgtcgcagcggtagcaatctcactcttattaatccaacgccctacttcattaccgtaacaaatatgaaagcaggaaatagcaatctcccaaacaccatggtgccgccaaaaggtgaagtgtcggtggatatcccgcatgctgccaccggggatatcagttttcagacgatcaatgattacggcgcattaactccgcgtattaaggcaaccatgcagtaagccagtgacctaattaataataaactcaatcggaattaataatgacagcctttcgtgccgcatttaaggcatatcgtatgcatcaggtgttactactgcctcgctttgcacggcttaccattgcccttagcttagcaactgcggtatttcccgttgacgcagagtattattttaatccacggtttttaagcaatgatcttgctgaatctgtcgatttatccgcctttactaagggacgcgaggcaccacctggtacatatcgggtcgacatttatttgaacgacgaatttatgactagtcgggatattacttttattacagatgataataacgcagatctcatcccatgcctgagtacagatcttcttgtcagtcttggcataaaaaaatctgcgttattagacaataaggaacattcagcagaaaaacatgtgccggacaacagcgcatgcacaccacttcaggatcgtttggtcgacgcatcaactgagtttgatgttggtcagcaacatctgtcactctccgttccgcaaatttatgttggcagaatggctcgcggctatgtttctcctgatctgtgggaagaaggaataaatgctgggcttctaaactatagttttaatggtaattctattaataatcgtagtaaccataatgcaggaaaatccaactatgcatatttgaatttacagagtggcatcaacattggtagttggcgactacgcgataactcaacgtggagttataacagtgggagtagcaattcatctgacagcaataaatggcagcatatcaatacgtcggctgaacgtgacattattcccttacgctcacggttaacggtaggtgatagttataccgatggcgatatttttgatagtgtgaactttcgtggcctcaaaataaattcaacagaagcgatgttgcccgatagccaacatggtttcgctccggtgattcatggtattgcccgtggcaccgcacaagtgagtgtaaaacagaacggatacgatgtttatcagactactgttccacccggcccttttactattgatgatatcaactctgcggccaatggtggtgatctgcaagtaaccataaaagaggcagacggcagtattcagacattatatgttccttattcgtctgttccggttctccaacgtgctggatatacgcgttatgcgcttgccatgggggaatatcgtagtggaaataacctgcaaagctcccccaggttcatacaaggtagcttgatgcatggactggaaggaaactggacaccttatggcggaatgcaaattgcagaagattatcaggccttcaaccttggtattggtaaagatttaggactttttggtgccttttctttcgatatcacgcaggccaatacgacacttgcagatggcacccgtcacagcgggcaatcggttaaatccgtctacagcaaatccttctaccagacag

SEQ ID NO: 86 - DNA  (genomic), 1548 bp; double-stranded, linear
caagacccgtctggcctatgctggtttaaaaattagtgaatttggctctctggactatggccgtaactacggtgtcggctatgacattggttcatggactgatatgttgccagaatttggtggcgatacctggagtcagaaagatgtcttcatgacataccgtaccaccggtgtagcaacctatcgcaactacgatttctttggcttaattgaagggctgaactttgccgcgcaatatcaaggcaaaaatgaacgtactgacaacagtcatctttatggtgctgactacacgcgtgccaacggtgacggtttcggtatctcctcaacttatgtttatgatggctttggtatcggagcggtgtataccaaatccgatcggacaaatgcgcaggaaagagccgctgctaatcctctcaatgcctccggtaagaatgcagaactgtgggctacaggtataaaatatgatgccaacaacatttactttgcagctaattacgctgaaacattaaacatgaccacctatggcgatggttatatttctaacaaagcacaaagttttgaagtggtggcgcaatatcaattcgacttcggcttgcgcccctcactcgcttacctgaaatcgaaaggcatagatctgggccgctacggcgatcaggacatgattgagtatatcgacgttggtgcgacgtatttcttcaacaaaaatatgtcgacctatgttgattataaaatcaacctgattgatgaaagcgactttacccgtgccgtagatattcgcaccgataacatcgtcgctacgggcattacctatcagttctaacatcctctcctgaccagcccttctctgggctggtttttgatttaagtgctgctgtatgactccttaagtaaaaatgagcaatttttgatatttctggtcattcacctcaattaatattattccatacccccggggacatcttactataatatttattgatgagtgattatgaccaatattaatacagcttgtgtaaaaaataatgccagttatcaatttaataacgcattacctaacaaagaaaccatctccagcaatttttgtgaacgactagaacaatggggtaataagtcgcttaataatggtgaagaaagagcaattgccgtggagcgaattaaagaagcttacaattcgaacatggcatctcttgatttgtcatatcttgatttgagtgagttaccgcctatcccctcgacagttaatacgttaaatctggaaaacaattgtctaacttgtcttgactttactgacaatgccagtctcgttaatatcaacctcagctttaataaaattaacacgataacctttccaaatgaatcaaatctggaaaacatttatattgatcataataatctggaaagtttagatttaaaaaatcagcattcattggttaatctggaagcgcaaaataataatctaaaaaaattaatatttctgatagttataaactgaaatttcttaatcttgattataacaagctagcatcgctggatgtctcccggcaagag

SEQ ID NO: 87 - DNA  (genomic), 653 bp; double-stranded, linear
ttataatctggcaatcacaaatatcgataccagtgatgaacatcttgtagaagtaagcgataattcagaaggtaattatataaaagacaatgactcaatgtctattcgttatagatcaaaatattattccagagattccgccttaatagaagaagaaacaatattttctgacgcagaactaaaagctattctgcctatgcgtcgcatgtacggggttagtgactataaatcaaattcctcttctctatcctcacactcgggactcaaggacccaacgggcacacccgtctgttattatattcataatgagagtaaaccttccttaggttatggtccaacatccaataattggttaagccaatcctttacaacagagttataaaacacatcctggtttatcaagggtgataaatcagaaaaacattgtattactatggagcagttatgaaattcccttcaatatttaacaaaataaaaccacaatccatacagcaacatccagaaaaaaatcaacttaactggatgctcgaattaaataaatggaaagaagaacgtatacttacaggtgaaatccatcgtccggaatgtcgaaacgaagccgctaaaaggataaactgtgcttttttgtcgaaacagaatgacattgatttatc

SEQ ID NO: 88 - DNA  (genomic), 33 bp; double-stranded, linear
tttggctctttcttttgttctgctgttctgctg

SEQ ID NO: 89 - DNA  (genomic), 1206 bp; double-stranded, linear
aatctcacataggatcagatctcgtctgatcgttccccctgcgctcactaccatggctctttaccacagcagccggggttgtttgggaccgactttcgacagcagatcccggtgggcctgccaccatctcttcacaagcttatgcttattacatgcaaaacgtcccgttttgcatctttgtgcctacggcacaccgatgatctttccctgtgatctttccctgaatctgcccctgagaacctgaatcaaacgtctgactcgcagaaccatctgtttctcgcgctctgtagaacttcatgaaaaagtcatcggtgcttttatcgaaaaatacatgttctactaattgaagtcatcatcaaaaaatttaattaatcgaatcatacctataaccttttaattttacttttttgtcttcaacattaaacacaaaaacctcttggacaattctttttgaatattctgagaaatatatcaatgtaatttcatcgtttgaaaataatccgcgagtgattttttcagttttaagggttgattttttataagtcccaagatctttttcttttgcttcgttcattatgtcgataaatttttttcagatgtggcagtctgaaaatcacttgaagtgattttatatatatcactgtatttccctgtctgatataaaccacgaaagatattaacttcttgtctagctggctctatgtccactggagaacaaccatacaataaaaataaaactaaaaatatatattttttcatatttcctcctgttaattgacccagcattcttgccacgttctacaagccagagtcataactgaagcgtcaacacctgcaccgataccaacagattctgtcgatgattctggattatcaacatccactacataagtatacgcaaaatgccccccaactccgccgccaaccgttacacctactgaattgctgactcccgatgtaggtaaagacttggtctcagaatatgtgatagccgcatttatcccaccaccaattcctgcatgtccgcatgctgtagcataaatacaaatatcagataacatttcacctttctttttagcaaacgcaacgccaagtcctgcatgaccacctaatgatattagatctccactgccagtaatatcaattgatgatgttccatatgaatcatcatgccaaacatcatataataattgatataaattatac

SEQ ID NO: 90 - DNA  (genomic), 4453 bp; double-stranded, linear
tttctgtaaccacccgtgctcatcatactgccactgctctgccgggtcgccgttcaccgtccggtgcgtgatgcggtctgcttcatcgtagtaccactgcgtgacctgcccctcatcctcgctgcggatgagctgccctgtggcgctgtaccggtaacgctgtgtcctgccatcaaagccgcgctgctccgtcaggcggtccagcacatcgtaggtaaattcactccggctgccgttctcgttggtcagcgtggtgacacgtcctgccgcgtcatactccatactgcgcgtcagcccgccctgtgtggtgctgaccgcctttccccacgcatcgtactgtgtctcgctccggttgccgtccggggtgataacggcagtcaggtcgcctgcggcgttgtattcataccgcgtttcacggccctgtgcgtctttcaccgaggttaaccggccacggttgtcatagcggcggtaacggctgataccttcctcgcggtgaaccgccgtcatctggccgaagcggtcgtattcataacgggtctggtagcccgagcagtcagtgaacgccagcaactgcccgtagcggctccacgtcatctgccgggtgctgcccgtcgcatctgttgtcgtggccggtaattcactgtgcggattatcataagcataccggatgacgtccccacagcgcgatgtctccgataccagcctgcccggttcatcatatgcccggcggctctccagcccgtccggggacaccaccgccgtcagctggttcccgtcgttatagtaaaatttcgtctcccgcccgtccggtgtggtgatgtccgtgatatcgccggacaccacattcagaccgtactctgtccgccgtcccgccgcgtccgtctgcgccgtgagccttcctgccgcgtcatacccgctgtgcgtgacgctgccgtccgccagttcttttttcaccacccgcttcagcccggccccgccttctgtatgcagcacctcacgccggttcaggctgtccgtgacggtgatgcggtcctgctcatactggtagcggtaactcaggcctgccgggttcagctgctccaccacccgcccggtatcgtcgtagcggtagcgcatctccgggcttcccgcgtaacggtgcgccaccatccggcccggatgctgcgcgttatacgtgaaagcgcgcacctgcgtattgctgcggtcatataccgccagcagttcaccggcttccgtatacgtgtaccgcgccagtggcgcaccgggcaggctttccgggtatgccgggtcgtgcgtcagccacaccgccgaaaggcggatacctctgtcgggaccgtattcggtaccgggcagtgtgtcggggaacgctgagtctgaaagagggcggggggtgtcaggggaagataaagaagcggtgtgctgtttacgggcctcttccgcccgctgcgcctgcgtggtcagcaccagacggaactgccagccggcaccgtcngtcacgccggtgatttccccggtcaggtcaccggcggcctcatgcctgtacgtcagcgtccgcccgaagcggtccgccatgccggtaagcacccggtacgtcggcagcgacgctggcagtacgtcctcagcacacgggcacccagctcctaaccacnccaagtatccaccactggccnctgtgcgctgttggtcgccaggtaaagatgcgggcttaaccgnatatccggctgtcagcagcccacccacanggggtcaagtgtggccgtccggctgcgctgccttaccaccgcgaaccagccacattgactcgctgcggctgtacaccgccccccccggcagcagcggctcaaagtgaatgctccgtccgccgttgtcgttgagtaccagtgcatcatcgcgtatctgtaagcggatatcagaaggcgctttccagccggggccaaaaatccccaccggcgcaggcgtcttcgtccggtagctgctgtaggtgcgggagagaatgaacggcagcgggccgggcagcgcaaggtccgtctcgccgggcagcaccttcgcccccagcagcggatttaccgggttgcccgaagtcatcctgcccggacacaccgagcacgccacgccggtgggcgcgccaattcttacacctgccgaaccctggacaatgggaccgccatactgagtcatatctccctgacgcgccgctggttttccgctcatgattcaattccttcttctgtttatttttaatgcttgtttgttactgaataccgaacaggtacgggatcagtactctctcatatccggcgtatcctgcttttcatcaggggtcttcggtggggatttcgaggctgcacagttccagttaatcaacagtgagtcaccattaacctgctccttaccctgcaaatgaatttttgtgccgttgagaaaaatttgtccgtccttagtcagcaccagccttgccttaccacagcagagttccagatgctcaccggcggagtaaatcgcggtctgcccggtatcatcctttttcgttttaccagcggtgaaggtaacgttatttccgactttgacgtcataacccagcccgaccctcaacgatttatgcaaaccgatctgcgaggactgcatcagagccaccgaagtgttcataatgccacctaccgtcgtctggtacgccacgcccacggtcagcgcacgaacaagtccaatcgtttccacctgaacagaacccacgttaatgatctggttactgcccaccgtctctatctggttaacgcccaccgtctgtatctgattgttggtaaccgcaatcatctgattgttgccaatggtctcagcatggttgtttatcacatccgtggtgcggttattcagcacctcggtgttcatgttcttctgcgcgtggatgtagacctgttctttccctgtcgcatcgtcaaacttcagttcattaaacccgctgcccttatagtttttcgaacgaatggtcatctgcgtcttcgtccccggcaggctgccgggtgtgcggttttcctggtggtaggtacgccccataataatcggctggtccggatcgccgttgaggaagtccacaatcacctcctgacccacacgcggtatcgccaggttgccaaagccggtgcctgcccacgcctgtgccacacggatccagcatgaactgtcctggtttgacgggttatagcggtcccagttaaatttcacccgcacgcgaccatgttcgtcgcagaagatttcctcgcctgccggtcccgtcacgacggcgctctgcgggccatccaccagcggtttcagcaacggctgtggtcgccatgtccggtctgccggtattaccgcaaagtggttattcagcgtggtacctgaacccctgcgtcccggcaccgcctgtggctgctcgccgtgcagttcacttgccaccacctgccattcccggttcaggttcgcctgcggatgccccgtcagcacaattcgccgtcccggccatatttccggagaacggcttgttccgcgcgccacttctgcgttgttgcgccagccatccatctgccagcgggcaaagttctgcccgtgggcacccttgaaacgtccggggtagtcatacacttcatactgtgtgcgctggtaatcctggtactggccttcctgatcaaaacgccctgcccagccgggtcgtttaaaggtgtagtccttggtcaccacggaagaagggcggatttgtgcgctgtagcggaactggctgatgcatagggtgctcacctcggtacgggtgttcgggttccaggggatctcaaaggactccggcagataacgcacggtgtcgcacaggaccaggctctggtcgatacttttttgcgcgtgctcctcataaaagaagatgccttcctccgccgccatccggcacaggaaatcgtaatcagtttcgccgtactggacacaaaactcacgggaaggatgcggctcgctgaacagcggactccactcggtcacaccgttttctttcaggatcgtagcgagtatgctttcgatgtcctcattctggaagatacggaagttctggcgcagccctgtgcgccacagcggtgggcacaccttcatgctgtacagcatctggtttttgtcgttctcccccagttcaaaccaggtcaccacacctttcacccggcgctgtacgtcatcgccctgccataccgtcaggtaggccattttgtccagcacctgcgcaaattcaagggaaagaaactgctgactgaccagagaaaggtcgagggaaaaaagtgaagagagtgactggttcagatgaaaggagaccaccgcaaacgcgtccggtggcaggccgtccacttccagcgtgaaacgtaatccggttgacatagcaacctccgtgaaaatgaataataatccgcacatattgcatgtacaacatgtcgggcggatgaaa

SEQ ID NO: 91 - DNA  (genomic), 1813 bp; double-stranded, linear
taatgctttttctatctcgccatcgcgaaccagacactggttttagtcatacactatttgcggagaaactgttgataaaacatcaataacatcatttgacgtggcaataacataatgttcgatcattttatttttatgaatttcacaactttgcatagtaaaccatgtaagataagtggaattggctactctatagatccccgtttggttaattccctgctttcctgacatacctaacaaatcaccttcgtcagtaacacgaaatgagtgtatccagtcaaatgatatcttaacttctgacttgatcgccgggcatatcagggccagttcaagcctggcattcttatagcttaaacctgacagatcggcgtgtttaaaagacaacgaagtcggcgtgatatttataaaacgttcatccatgttaacacccttaatatatgagactgtactcaatttaaccttctacaaaaatggtgtgagtctgtttaagtaccatgtataatcgataaccgttgctgaattttaaaattatcttgtccagttattaaccatttttcatgggaaacatctgcaatacattcattaatgcgaaatacaatttcccctcaggcacccatattctaatcttatcatcccctaatattataaattgcaattgacgtttgaaatctaaagttttattttcaggtaattcagtttgtatttttttcttgatatcatcaaggtagatgtgatgacaatgttcaccaaacatactcatcacttccagaccgtttacagatgtccatctttgttcactttcccaataaacaagaaccggtttgcgacaggtatatctgcctaaaaagcgccgaatgtgttcttcctgattctcgtaaaatattgcctctgcattcgagatttgccgacgcattcgccagcggattttttcttcataaaaagacaagttgtcgaatttgacattacgcacattcattgtcaataactcgcatggttttaaatgtaaaacttaaaaaaccaccaaacaaatgaagtgaaattttatacttctttgccttataaacaattgtcgcatctttaatattacctgcattttggttatctataagttcagcaatatccataacctgcgataaatgttccactcctgtaaactcgaacctttttcgttcccttccggctgtaaattcatcaacataaagctccgccgtcaatataaaattatactcggtgtggtgacattccattctggtttctactaaaacaccatcatgccagataatattttctacatttttcatgctattaactattctcaggtaagtaaccattagagtttctaaactggttcgatgacgcagatactctcgttaacaaacaatctagctcaaatgtgcattgcgtaattatgatatcattattctttttaataagttcacgcaaaacacttttttgagtttcagtaaattcaataacatttattgagcgtacaaaatcgctaatggtctgttggcgtagaaattttttctgtgacatgatgtaaaaaataaacttaaattcgtcgtcaccgacgttaagtttaatcggataaattattgataaaatatacagcgcgcgtcggtaattttcctctggaagtttttcatagaaagatattaaagcctgaccaacgcgatcaccctctattatccgttcaaattgcgacctcagtaaaatatcatgtctactcattgcaatacgtcctgttcgcccaaggcgaagtatgaatgaaacttatgtaaaatagtaccgcccttgctatatttcagaattc

SEQ ID NO: 92 - DNA  (genomic), 32 bp; double-stranded, linear
acattagacagcaaaagataagtcaagcgtcg

SEQ ID NO: 93 - DNA  (genomic), 4268 bp; double-stranded, linear
cgctttctgtcgcaccggcagtacttaccgccacggtgactttcgcatccaccacgcccttgttaataaactcgctggcgccatcgtcgtagtgaatagcgcccgcacctaatgcggcatccagcgtcatttcaccggtgttatataacgtggcgttagcattgctgccctggaagcgaatggcgtttttgctgttatcaaggatgagtttgccgctgttgttgaacgttgacttatcgtcaatatccagcgtcccggcattgttgttttcatcctgataacccattttccaggtacccgcgttattcactaccgcagagttatagagaatcgcgcctttacgcgcctcgccgcctgcaaggttattgaataccgcatcgccctgagcgttaacgcgcgccgacgcaataccgctgttattcaccgtaccatcgtgaagttgtaaagttgacagggaaccggtgttattaattaccgcgttgctgtttttctcaatttttacgacgtcattaagcgttccgttgttattgaaggttcctccttccagagtcaccgtgttcaatacaccttcattggttaacgcaccgccttcattcacgacgatggctgagctaatggttccgctcgactcgttaaccagcgcaccattttcgagtatcctgatcgttccatttttaacagcacccgcactggtgacatccccgttgataatcgcacctgacgataataatacggtctcacccgcagaacttaatacagcgccatcatcatataaatcagcaatataattatccgttggattatattcatcggccccctagcaaacgccaaaggtacaaattgtgccatagttgataataagcccagtgccatcgttatagaatgcctgaccattttccgcgttaatgttgattacgcctgtctggtcattaatggcggtgccttcgtgataaaccgccatgccgacgagtttattcacaccgagagaatcgttgtaattttcatttttctccaggttgatggttccctggttaatgaccgtattagtattcccatacgccgccatccccgcaccggcgttgtagacagtaatcacaccattctcgtggttggttgccgtggctttagttaatgccccattataggcatcggtacctgaagccattcccacaccgaaatctttcgccgtgctatttgcaacattattacgcagcgatgtttcatcattttcatcaacccacagcgtatccagggtgatttgcccttcgttatccgcggttgatttatcgatggctagcatccctacactgccacggccatacatatcaataatacccgtttcgccgttcagaatggatgacgagtagctggcaagcatacctgtcagccctaatgccttgttattgaaagaggtaccatcagacaagttccactctgccggataattcagcacactgtgctgattcatcattttggtggtcatggtaccattgttaacgccaatcccaccgtattcaacatcaaagacttttggtgccgggtcggtaccaaaatcgtacatcgccaggccaatggatccgttattgattaccgttgaatctttattccaggcagccgcaaaaccgatatttttcagttccacttcaccgttgtttgtcgccttcgcaccagaatcaatactaatggtggataacgctacacgataataataagtgaaagaatccacatcactcatatcaaacgttgcgtcagcgccaatctccagctccgcgccatggctcaactgaatgagattttcgaaccccagcgggaactcgccgctgatggttgactcaccattcaggtagaccggggaatgcccatcaacgttaataagcggtgtgtctccgataccacgtcgagaagctgatggttttgagccatcatccatgacatttttttcaccgacaaaatggacaccgccattaagcgtaaaggtattgtcatcgccagcaataacaatacctgcaatgtgttcctgagcaccgtcgtaactcgcataggaacgcgacgtggttttactatcagcaacaacggttaactgaccatccagcgtgacgtcgttgttgtcaccgctgatatttaccccggttgagggattaaagaagtaaggctgcgcattatcggctttctgatctttatcaaccagaatactgcccgctatttcgatagtattaccatcacccgaaacattaacacccgtcgctttttgccctgtcacattcagctcataagtcgccagcgtcatgttgttattattgccagagacatcaagaccggtggagaaatccccaacgtctaacccacccgcgagtgaaatattagctttatccccagcaacgctgacaccggttccggcattggtcgcggaaatatcaccaacgttaacaaatgtcgcattatcaccgtcgatctgaatgccaatggcattttcacccgctgcggcctgaccaacattgaggtcgcccatgttgatcacgctgacgccatcaccatcaagcagcatgccaatagagttatcttcgatgaccgtaatattacctttgttgctaacgaacgtatcattgccgtcaacgtcaataccgtgcgcaccaccgcttacgtataagtcgccttcctgtttgatggtggcaccgtcaccgacaattttcgagccagtggaattctctccgtcaacgctcatggtaccttgattatcgacccgcgcattatcgccattgataaggctacccgtaccaccattggtgatggtcgagtcgcccgcagtgtttagcttggtattatcgccattgatgattaccgcggtaccgccatcaacttccgtctcgccattattgttaatggtgatattgtcgccagtgagtataccgacaaccgagccttctccgatggccgtcgttttgccgtcgttgttgagggagatgttgtcaccatcaaccgtcatgacagtaccgccattcagcgccgtgttgccgccctgatcggtgatgatcgcgttaccaaactcaatcgcattcccggttgtgccgtcaacaacgacgccggcctctttagtgatgtggatgagtccatcatcgtcgtaactccaggtgatgccacctgaggtatttacgccatcaaagacaacggtgttgctgtcgtcatggactgtccaggacttaactatcgtctccttgccctcaggcgccgttaaggtgtagctcccatcggcattttggctgtaggtaaaggtagtttcgcgaattttgacagtttttgcatcctgatcccaagttacgccatttttatagacgacaggattgtgtttaaccggggtatcgccaccatcgtctggcggaactggcgtatcaccgccgtcatctggcggaaccggcgtatcaccgccgtcatcaggcggaactggcgtatcaccgccgtcgtctggcggaacaggcgtatcaccgccatcatccggaactggcgtatcaccgccgtcgtctggcggaacaggcgtatcaccgccatcatccggaactggggagttattatggtggtgattgtcatcgtcacttaaggtatatatagcaattcccgtagctactgcagcaagacctgcagctgcccatggtaaaactgcactatctttattttctctgcactccgcggataaattttctagctgctctttgctcagggaatgaatatttgccggacatgttatcttactggacttacgtgttttttcggttgagtcgggtattgaagtatccgcagcccatgtctggctacttaacgccatggcaacacaaacagacaataattttttcctttgcatataaaattccttagatctagaccgtgcgtaacaagccatgcagaatttgaagataaatcgtagtaaatattcatagtgaaataagcagtaaagaaatgcttatataattcacaaaatcaatattaaaatcaggcaagtaaaagcatacaaaaaaaacagttgatggaattatattccacaaaaaactcacttcaatctaaaaattaacgacaaaaaacaaaaacacactaataattcattgacgctgcatatatattttgtgattatatatatattggtaatgatttgttatttaagggaaggatatataaggtttttgtagaaatacccacggtaattaagcatgctaacgtcagtttaaatactgtaaaagatcattacattaatagatacattttgtagccaactataattt

SEQ ID NO: 94 - DNA  (genomic), 3404 bp; double-stranded, linear
tctataactaatcaatctggcgcccatgatttctttccaatagaatcagttccggctggaaatcattagatactcgcactatcgaaaagcttaccagccaaccgcggcacgttcttgcatacgaggtgccgcgttttacatgccgtaccgagaattaatttcattttacgaaaagttaacccgccattgctaccttaattttttaaaacgaagttacctctgtcagggtcaaaagcacaattatctcttcctacaatcattgaaactgcgattgattccctgctcaaaggatgagccgcccttgttttaacaagatgtattaatgccattttatcatacaacatacaaacatttgaattcattgaattcctcataaataccccatcttctggttcacataatgtaacagggcatgttcgtaagctctctggcacttgcaattgtgcatgctccacattaaatgcacatacttcaattttatctaacaactcctctaactggtagttagaaagcaattccatattttcgagcatctcaatttcacgcagtactgtaacttcacggcttgtcaaactaccatgattaagtgtacgttcaatatgttctatatattgaaggccaatctggatgttatcattcgataaaccatcctggttaagacttcccataaaatatccatttacctgcataggtcgtattgacaccatcaactcacccagtcttacttgagcttctccacgaatagtctgattacgtatctcagacaaggtttcttgaggaatgtcagacaaaaaactaaccccaggtaaaatataaggcgttaaatctacaggcattcctctccctccattttaataacttaattttgctttagtaaaaaataaaagtacataaaactacatttatatcattaattatcacttacaacaaaaagcttctctttttgtatcaaagtgacattcatcttttctcataatcattgattctgttataggttctcgactcagaggatgagctccaccagtttcaacaagttgcactaacgcgtccttatcatatagagagcatatctcagcacctcgtgagtttctcatgaacaccccagtctcaggtgtgtccagcgttatcgggcatgtcaaaaatgactccgggcaagaaaagtgattagaatcaggtctaaataaacaagaatttattttttccattaatattttattacttgttttattttctctgtgttctgccatgacactctgaaaatagttattaacactacttaaaaaatcgacacctccatttaattgcctttccagagccacagcccttctctccattcgatgctcacgccccaatagcctatccagtaagcctcctctcaccggttcaactgaaaatccatccagtagctggacatagtgaacagaatattggccactaccaatggatattcttattccactttcaagtctggcagcatcctgcaaagactgtactcctgcaggagataattgagatatacttgggatacttaaggtggtaacaggcataaaaacctcattcagtaattcatatcagtttgcaggatgtttcattaaataaaataaagggtaatgttcatttcaattaccctttataacgaagtttcctctggtatcgtcataaatgcattcttcatgttttacaattattgatgccgttattggttcccgggtcagtgggtggggtaagccttcaccaaccaaacgagaaaatgcagcggcatcaaataaagtacatacatctgaaccatctgaattcttcacaaaaatacctttttcaggctgctccagtgtaattggacactgaatagcctcaagcgggcactgaagtctctctggacaaacagaaaacttacattgagatattttgttctgaatactctcttgcgattgtgcttcacctgagtccgaaagcatacttagcattctctcaccaagggctcgaggaccactattaaatcccaaaagcaataactcagaaagcaatccgccattaccgccactggatgaaaagcgcccattagtagaatcatacacaatactgacagtttcaccaccgactgtaatatctccgcgcccattggctacaattcgggcacgaacaacctccaccccaagattaaatgaatgtgatctaatatctgaggttaatggcataacaaagctccctattttaatttgaactccagacttaaatagctgtaacaaacatcccccatacgtgacaacaaaaaccagagcaggactccggtttttgtgaacccgtcggctatttcatcccgccaatattttcccacctcccgtcagcacgtaggatttgcagcggtcttaccatgcactgtatctgctttttatccgcatccagtatcaccacctgtgtgattaccctgtcctgctccggaataatgccattctcatctgactccaggatgtctgccggccccagtcgcagttgtactgtaagcgactgcccgtgttcacagtcatcatgctttccgcaaccacacagacgctccataagctttctcaaaatattcatgtcattctcctgttctgcctgtatcactgcccacttcatccagccccttaacatcctgccacggcccgtcaccaaacctgacctgcaaatgctgaaaaaaaccctgaacccgtgtggcatctttgggggcaagaaaggtcagtccggtgatgagtgcgccatctgtatccgggaaccagccattgctgtttgtctcaataatgtttcccggccccagacgaaaacggatttgtgtctcccccgggtcgcccttcggtccctgaggtccggttgcccccaccgggccagccgcacctgtttctcctttcggtccctgtgggcctgccgggcctgccgcaccggtatctccctttggaccctgtggacctgcatttcccgtcagaccggtctctccccgctctcccctgtcacctttcggcccctgcgggcctgccggaccagcatcacctgccggtccccgttcgccggttgccccgacagggccggtgtcaccgcgctctcccttatcacccttcggcccctgaggacccgcgggcccctgttccccctttggcccgggaggtcccaccacggtggggattcggtttacggcctcttccgccgctatcctgctttgttccgctgactgtgcgctttctgctgactcccgggctttttctgttgcggtcgttgcatccctggctgcattaccggctgcactttctgccgtctttcttgacaattcagcttctgctgcactttgtgatgactcactggctttttgagcggccgcagaagccgaggacgaggacgcatcctctgactgctttgcagcggctgcactttct

SEQ ID NO: 95 - DNA  (genomic), 101 bp; double-stranded, linear
tacggtggaaccatttntttaangcggnacagagggcccggccaataangntgaaaccagcggttacgaaacggaattttcatgccagcgggtatngctgt

SEQ ID NO: 96 - DNA  (genomic), 34063 bp; double-stranded, linear
cgacgtcaccatccccagtgtgtccgtaaactcataacggtatttcacgttaatcccgttcagttcatcgctgccaggaacgttcgtcgagacatgaagataccccgcgctcagcgttgactgatgttcagacgcccatgcaggcgcaccggatacggccagacaaatggctgcggacaaaatggcggcataaagtttacgcataattacctctcgcttttctgcaataaaaaaggcgccatttctggcgcccgtatatgggttataaaattcagctgatactgatgcctgcggtggctttcttcatcaccacaaccagcaaatcgctgatacttgctgtgggataccagttattcaccagccatgctgacaccgaaaactccagcgtcatgtgaccgtgaccggcaggcatatcaataacgccactgtaaatcagcgtattatccagcgcggtacggttataaatttcagcaccgtttttccgcactatcagacggcatgaggagtaaatatcagtatgctctctctcatgtttagcgccgctgaatgccaccgccggaataacaatctgccggtcaaacggctgatcgtcataaaccctgacggtaatggtccctgatggccaccgctccggtgcacgggaatcccgggggaaagctttgcccactgttttaacgagatcgccttcaatctggttcgcggacagttttcccagaacccgacagttctcgttaatcgtgacgttgttgagcgtcccggaattcgcattcacgttaccgctgatatcagcatttcttgcggtcagcctgccctccggcgtcagggaaaacgtcgggggattggcggatgacgtgatactcaccgcaaacagtcgtttcaggaacacatcgttcatgaacaactgattcccctgcgccacaaataacggcgtggtgttgccgtcctccgggttaatcatcgcaatacggtcagccagcagcagtatgttgctcaggggctggccatcagtatcctcaatccccgctccaataccggcaacatagggtatgccattttttgttttctgtaccttcagcatgtaaagtgcagcaaggtcatcatttgtgtccttctgcacgcgctgtatctgctgtatgatggcgctctggtcctccagcgttttactgaccgtctgtgtgatttcattgcgggtttcggtgatggaggtcttcatctccgccatctcatccgcaagctggctgttgtctatcagctcccacagcccctgagccagatgcagttttcctattttttcccgaaacagccccagatacccttctgcatcattgctggcccggccactggcttccacaaaagcagatttccccaccaggttgacgctgcgcacgtaaaaccagaaatccttcccgggcttaatgtgcgggccggatacactccactgactgccggtccccagataacgggcagaggtttccacctgagatgtatctgcgatttttgtctccgaaaaccagaactcaaactgtaccgtcgggtcatacaccgcaagacgcgggaccgctgttatctgaaaatagcccggtgtcagctcaatcgtggcgggtaccgcaggtgcattaatcctgaacgtggtggtggccggttccccctgctggccataactgttaatcgccctgaccgtcagggtgtattcccccggcggcagaccactggaacgatgctctgtatccgcagtgatggcggtggtcaccagacggctgccttctccgcttccgctggtcaggcgcagactgaagcgcacgcccttcaccacccgcggcgtgtcccatttagcctgcgccagatactggccgtcagctgcgctcacctccaccgtcaggtgctgcactgccggagggatgacgctgttcagggtgcctgactgcggctcaaagcgggcaccgttatccacgatggcttctttttccggtacgtgctgcactgccgtgatggcaaaggtgccgtccgtgttttcccggatggagacacagcggaacaggcgacgacgcagtgacggcagggagagcccccacacaccgtatgtctccacgccatccggcagggtgctgacctgtatccggtccggcgcggggtgtgcagtgatggccacgctcaccggcttaccgctgccgttaatcaggttcaccgtggcggcaccggtctccggcagggtcacctcacggtccagtgtcagggtgcggctggcggcatcgatggacaggacacgtccgccggtcatggtcccggcatagtcgttatcacagatttcaataatgtcaccgggtgtgtgacgcagcccctgtgacccgagcgtgaaatccaccgtctgcgtttccagcagtccggtctttatcacccacagcccggcacggtgggcctgaccgcgactggtgcaaccgaacgcatccatcttcagcaggttgcgcccgtagcgcagtatggcttccgggtcttccaccagttccgtggaggtctgccagccgttctgcgggtcggtgtaattcacctccaccgccgtgtggcggtccttcagggcgctgaagctgtagcgaaaccccacgccgttatcatccaccaccacatcactgttggtgtacggccacaccacatccgacgggctgtcctgaacgaacgtcagcgtctggccgttccataccggcatacagcgcatcgccgagcagaaatcactgagaacgtcccacgccttacgctgttgtgacaggtacgcattaaaggtcatccgcggctctgtgcccccgaaaccatcagggaccatctggtcgcagtactgcgcaatggcatacagcgcccacttgtccacatccgccgcccccaggcgttttcccatgccgtagcgcgggtgagtcagcatgtcccacaggcaccaggccgggttgttgctgtatgccggtttcaggctgccgtcccagatgccgctgtacgtgcgtttttccgggtcatagtttgacggcacctggatgatgcgacctcggatatggtagttcaccgtcatctgctggccaccaaactgctccgcatccacctgcagccccacaatcgccgtgttcgggtagcactgtttcacatcgatgatttcggtgtatgacgaccagagcgtcttattctgcagctggtccgaggtgctgtccgccgtctcccggaccatccggatgttaaaaggacggggaggcagattatccagaatcaccgacgccagaaactgcgaggtggtcttgccgttaatggtgacatccttttccgtcacccagttaccgttacgctgcaactgaatcagcagtcggacagaagagggattacggtcgccctttgaggtggtctccaacagtgactgcaccccgaaggtgacccgcaggcggtcaatgttcgcggacgtaatggtgcgcgtcaccggctttgccttcgtcacttccacgcccagtgcggtttccgccccggaggactcaaagccttcaggtggtgtctgctcctgctccccggcgcgccagaccgcggtcacaccatgtatcacaggattaccgtccgtgtccgtcagcggggttttgttcaccaggatactctgcagccccttcaccggaccttcaatcggcccttcaccaatggcatcaatcacgctcatcatctgcgtggacttaagattgtcctttgcctcaaccggcgtgtgcgccctgccgccacctttacccataatgttcctctcaattggtattattaatcgcagtgataggatattgcacagctattgcgcgatatcatcagaacgctgtttgttaccctgtaaccagcaagctcagtctgttaacggaattaatgagggttttatgaaatgtaaaatcattgctgccattgccatgctgacagcagcatcatgcggatacgcagcagaacaggaagtcccaatgaaccttgtcagtgctgacggaaaagaagtcagcattggaaaaataaccattcaggagaccccntacggtctgctgttcacaccagcccttcactctctgtctgaaggcattcatggttttcatgtgcacgaaaaaggaaattgcgccccggcactgaaagacggaaaaccggtcgcagcattatcggctggcggtcactttgacccgaaaaacaccggcaaacatcttggcccctggtctccggatggacacccgggcgacctccctgcgctgttcgtgacgcatgacggaaaagcgaactacccggtcctggccccgagactgaactcattaaaagagattaaagggcgttctctcatgcttcatgctggcggtgataaccatcatgaccatccggagcccctgggcggtggtggtgcgagaatggcctgcggcatcattcaataatcagtcaggtaaggggcgggccccttacctttattcctcaggacgataaatcctttctccctgaaaagaacggcacatcctccctctctgagttaatgtttttgtcgtgacataagaataattccttacactcaatcttcgtaacgctcccgcagttcctgtccgtgagcactgcgggattttttcgcttttatgcctgccgcccgataaccaccaccttcccgtcaccgccttcatcacgggtactgatgtcctgggagattcgccgggagccaaccagcatttccccgtaaggcaccggcatcgggttcccctgggcaatcatgttatccagcgaggaaaantacgtgttctgtctgccgttatccgttgcgcggtaatcccgtgtttttgccttccgggccagcatctgggccacaccgcccagaatcatgctggctccaagtgaaaacagcatcctggtggcagaaaaaccaccggctgccagggctgaacccataacgccattgatgccccggcaggaagaaagagcccacgatggctgccgcccccagcacaatctgcagtccacctttccggccccggccagtcgcggcacaatatggatgaccgttccctcacccagctgttngtgaagacgggcgtacaccgcctccggtgccgtgtcatcaccggcaatacgtatctggtaccagccttcgttcatctgacggcggaatcccggcatctgcatcgacagggcacggatggcttccgctgccgtgttcacatacaggctgaggcggcggccaaatcgttgtaaatccccgtgaaggcagatacgtgccagtggcggtgacgccaggctgaatgcgttcgtcgttgccatttttcggaatacctctcccgtttactcagttgttcaggcagatggtgaagcagttcaccgttgccgcagtatatggcggcatgattggccaccgatgcgccaaagcagcacagcaggatatcgccaggctgtgcggaaggcagggaaatcctgtaaaaaccagtcgcctccatattgtccaggtacaggttctgaccattgcgccaccagtcatcctcacgctcaaaatccggcatatcaattcccgccagatggtatgcatcccggaacagcgtgtaacagtccgtcaccccgtgctcaaagagccgtcctgtcagatgtggcacacagcggaatttatgaatttccccccggcagaccagccaccaggacagtgcactttttatctgcagccgccggtcggcctcgctcagccagggcagaccaccgggatgactgtggaccagtgccacaatctccccctgcatctctgcccgcagccagtcttccggtgcaatacgaaaatacgcctccggctctgcagagatattcacacaagggatataccgctccccctccggcgttctcaccacgaagccgcacgactccgcaggcgcacaccgccgggcatgcgccagaatcgctgattcagtctgtgtcataaaccgggatttactgcgaaagtttattaatggaaaggaaaccgccaaaattagccaccatgccgcgcatctcacacccgcgcatgcacttgctgcatctgtccttacggatatcggtggtgggtttatcgaactcatccgccacagccccgcccgtgtaaccacactcatcagagcggtaggtccacatacaggtattcgccagcataatgcgaccgggaaacagcgctccgtccgtctccgtcggtgtggccagcacaaacgaggctgtcatggccgtcagctctgacatctgctccaccacccagcggtcgctcagctcctgctccgggtccgcttccggattgcccgccacaaaattcaccgcatccagaaaacgggcatacacccggcggcggaccaccgtggcccccaccaggctctgcaggtcctccgccatcccggtgaccagaccaaacagattggacaccgtcagcgacggtctggcactgctgcccttcccgttcatctcaaaaccgctgccgtcaatcgggtatacctgatattgccgcccctgccaggtgaccgcctcccctttttcattcagctcattacagaaaaaataccgctcaccgccctgcaccgtcaggtcaatttccctgagcaccacccgcggtgactgctctgatttaaccgactcgttcagactttcttcgtgaatatcctgcatcagttcaccacctgcttaaactcggcactgaattcaacccgcagcatgcgaacccgtgatgaccaggcggcacaggtcacctttatctgccgccaggcataaggcggtgtccacagaaacgccttccagccaccgtgctctgccaggaacgcttccagatgccgggcctcctcccgggtcacggaaagcgtcacacggtatgttttcaggtcagcattcagccctgccgccatacgctgtgagtacccgtcaccaaaacgcacttcacgcaccgatggctgcgagttcacctccatatccggcttcactttccagcgaaaggttttcatcgcccgctccccgataacataccgccatcacgcaactgcagccggagctcatcctgcgcccccttgcgggccatgtcatacaccgccttcatcagctgcggccccgcctgtccgttggtgccgtcgttctgaatcaccacgtgattgttctgattaaaattaataccttccgcccgccgcatctgcgccggacttccggcaccacccacataaccaccttccgcatagccgcgcatcaggcggtacaggttgccgacgccaatccggctggttgcttccttcgtgaagacaaactccccgcgatgaacaattcccgcaggttcatatttaccccccgtccccgtaaatcccccggtcgcgaaatggaagttcgccgccgcagcctgaatggccgtccccgtggaggcagacgcaccaccaccgaaagcaccgccaatggcgctgccgatactcccgactatccccaccatcgcctgcttcagaaaaatctctgtcagcatggacagcaccgaacgggtgaatccccgccagtctgcctctgcaccggtcagcatcgccgccatattctgtgcaataccgtcaaaggtctgcgtggcagcacttttaacctgcgaaaaactgtccgtcgcactttccgcccactcgccccagccggacttcagtccggccatccagcttccacgaagctgctcctccgcagaccaggtgttcttcagtgcagatgtggccttcgccagcgcatccggattatcaccgtacacgtcacgaaggcgctgctcttccgactcccgctgcgcctgacggtcggtgaggcccgcgcctgggcactgattgccgcctgcttcgcgccctgctgctgctcaaaccgcgcagcctgctgtgccagctcattcagccgtttctggtgttcaactttgtctcccagctcagccagctggcgtttgtactccagcgtctcgtctttatgcgccagcagggatttttcctgctcagataactgccgtttcgtggcagcctctttcaggaccgcatactgattttccgctttccataaatcgcgacgctgctggctgattttctcattcgcaccgctgtgtttttccagcgtcctgagctcggtttcaagcgccagcagggcagcatgcgcctggtcttcctgacgctcaccggctgacactttgactcctgacgacttcggctttttcagcgtcgattcataatcctttttcgccgccgccatcagcgtgttgtaatccgcccgcaggattttcccgtctttcagggccttattcagttcttcctgacgggcggtatatttctccagcggcgtcagcagacgctcatacgccttctgcgcctctccggtatacttcagctgtgatgcgtcccgttcggcccggtccctggcggccagttcaccggctttttccatatccgactgcagcgtggccgctgccagccccagacgggcattttcccggtcattccatgcgccctgaaggttggcccggaaagaggcggtttttccccggcgctggctccggctctggtaccactgccattttttatccgcctcatcaaatgccttctgtgcactggcgagcatatccgctgaggactcaggacgaccgatatccagaatggcatcccacatcgatttgaatgccttcccggttttatccgcccaggtctccagtgtccccatgttttctttcaggcgacgggtctgctcatcaaagcctttcgtggcgatatcgttcgccgcctgtaaggccccggcctcatcaccggaacgctgcagctgcgcaacatacgcaatctgctctgccgtcacgttacggaactggcgcaccatcgcaatcagccccgacgtagggtcggtggtcagttttccgaaagcctctgcaaccttgtccacctccacaccggatgcagaagcaaaacgcgcgacactctggttgatggcatcaaactgttcaccaccacgcacaccggcattcaccagggctgccagtgactctctcgcctggttaaacgtcagccctgctgcctgcccggctcttgagagcgtcagcatgcgatcggcagtcagtccggactgattaccggaaagaaccagggttttattaaacgctgaaagcgtggaatctccctggtaccaggcgtacaccagcgcacctgtcgccaccgccagcgaggtgaccccgaccatcggcagggtgatcgcaccggcaagccccctgaacatggggatcatcccgccgaaggagtccttcacctgaccgccctgttgcagcaggatcagccagggattctgaccaccggcaagctgcgtggcgatatccgtaaactgtgcgggcagggttcgcatggccgctttatactgcccgacggaaatcccggctttttgtgcagccagcgcctggcggctcaggccctgttcaacagcactggcggtttttctgacgtcggtatccagacctgaaaaatgacgccttacccggctcatctgctcatcgaaacggacagcatccagactcaggtcaataacaagatcaccaaccggctgggacatatctcacacctcccggaatccccgctgaagccatcattaatgcggcatcatccaccatgacatccgccacatccgcagacgataaaatatcgcgccctccgtccccaccgaaccggacgcctccggcaagtcctgccgctttctgcatcagcattttgtcctcatccggcctctccacctgctcttcctcatgccgggggacaagcagactgaaatcagagggatgcatatccggatcgcaaaaaaacaggctgagtacagcgtacgtcagcccggaaaaatgcatatccagctgggtatcctgaaaataatgcgtgcggtaaaaacggtgccagtcggcatattcggtggatgtcatcccggcaagcatggcgcgccagtcgggtctccccatctcacgcgccagtctgagggcaaagttcagctcgccgtcgaagactttcccgcagaaaaatcatcatcagtcagcgtgttatttttcgccacttcagtaatatcagtatccggacgaacagccccgctcatcccggacaggcacaacaccacgtcttccgcccgggcaatggcatcggcaggccaggtggtgagcacttcctgctctatcttcatcacggcctcattcattgacggtgactgcgttttctgtggatggttatgccacagggacatcgccaccagaaacgcgccggttctgacgagatcttccacgcttacctgcaggttgccgctggattctgcctgttctgcacgccgtttcaggagggcaagatgctcgatacgctgcagcgcagacaattcggaaagcgtgacagacacaccgttatattcaaattgttctgttttcagaaacatgtatgacctccgtttaccctgcagcgcccgcttcagtaacggtgacttcagccactgcggcgaactgaccatttccgctcaccacagggatctgcaccttacctgtcgccacgccgtttaccgtaattgtcatatctttcacactaatggtggctttcgacggatcggcggaaaccgctctgaacgtcttgtctgttgcactttccggctcaaaagaaaccgtcagggtggttgttttcccttttgccaccgtaccggatgtcggcgtcaccttaatcgcactgaccggcgtaattttgctgcgttcttccgctacagaaggtttacccacgttagtgactttcaccgtgcgggtgatcacttctttcgccgtcacggccttaccgatactgctgacccagccacgaaacacatccaccgtgccattcggaaaacggattttataggcccggacatcgccgctttcaaaccagcctataagccctttctggccttcctctcccggtttccaggccagcgtaaaactggtatcacctgcagatttctgcccctgcccggtcgcggtccagtccgcgtcttcatcatccaggtagttatcatcgtaggattctgccgtcatctcgcccggcgtcagatccttcaccttagccagtcgctgccagtcatcgtctgacaacgggtttgcataggcgtcaccctgaccgttataaacccacagggtggtaccggctccttttaccggctccaggggaattcgtgtttcggcttgacgtagcccggacgtaacacgcgggtttcaccaccgcgatgacgcagcacttttccttcaacaaccggggagacataggccgccaccggcgtttttccggtaattttgtccagcatcacctcttcggtatggaaattcaccgtacggcggaaaaacagctccagaaacagcgcacgaaatttcactttttgttcggtataaccgagtaactggcgggtcgtaaacaatcccataaatcagttcctttcattcagaaatcagtcaggccaccgcggtggcctgataacgtgttacggcagcgccgcgtgactcagggcactgccggcaaaggcatttgcctttttgtgttcatccacactttcaggccagcggattgcctccgtcgcaaaggtccccgacttgtaataggtcagtaccgtctctgtgccttcaagcggcagtaccagtatgccaactgcactaccggctttctgtccgtcccagaccaccagtttcccgctggcttcatccagcatcaggggcgtcagtgccggtgttgccgaggaaatcccgctgctgcctgtggcggtatgagccggatcattaccggcaaaaatacgtacttccgcacgctgttcagtgatgtttttcgttaccatattgtaaaaacctcctgttgatggtcagcactgacttcatggcatggccatgagcattttcacgtccgcatcaccgtctgctgacgtctgtggcacgccaccctgtaccgcagccggtgaatggttcgccatgatgcgttcaaacagggcggttgtggatgcagagaccggttctgccttacctgatcccgcagccagcacagcccgggcgctctccacagtcattcccgggcaggcagccagctgttcagcctgcgcctcagccccttttgcctcatccagtgccatgatctgatcacggagtgagggtccggcatccgcctgcggtgaagcagccaggatcgggcgggctttttccaccgtcatctccggcatcgccgccagcgttgccgccagttgttcacgaccgttcgcttcttcacacgccataatgcgatcggcttcactctgcgtggatgccaccggctgctgcggtgccgccgcggccagaatcgcccgggcctgttcaacgctcatgccctgttgtcctgccagcatcgtggcaagctgttcacgtcctttcgcttcctggcatgtcaggatccccatcactcgctggttctcctgcgcggcggcttccgttgcagttaattgcggcatagtgcctcctctgacattactgttcagcgccgtggccatcacactgatggcatccgacgcattgactaattcatccgccagcccggcatcaatgccggactgaccttcaaaaacggcggcctctgttcccgtgacggcatcaacagacagaccggtaaacatggccactttttcggcaaacatccggcgcgccgcatcaatgcgctgctgcatgttctggcgaacctctgccggtaaggcttcaaactgattgccatccaccttgtgcgcccctgagtaaatcagcgtgatatccacaccggcctgcgccagatgaccggcatagctgacatggctcatcatcacgccaatggagccgatacgggatgtctgggtaaccagccgtcgggagcaggccgacgccagcagcatggctgcagaacaggccgtgtcattgcacagtgcccagaccggcttctgctgacggaggcggtaaatcatgtcagcgcagtcaaacgcgccggcggcctgcccgcccggactgtcaatgtccagcagtacgccccgcacctggctatccgccattgcctgctgaagacaggcgacaatgccgtcatagcctgtcattccggaaaatggccgcataccccccagccggtgcaccagcgtgccggtcaccggcagtacagcaataccgttcaccacccggtaaacacgggccggtcgtttacctccggccatgtactcgtccgtttcagccagcattccgggagcatcaagctgtacctgctgctgtggtaccgaaagacttgctgcccccatctcgcgcccgagcgcgcaaaagaaaacccgcgcataggcgggctccagaagcagcggttcattgaatgctgcggcaataatgtgtgaaagattacgtctcacggggtgttgtctcctcttccggcctgcgactctccgctatctgctgctgatacgcctgcgctatccacaccggacgtgagagtccggctttttgccgctctgcagattccctgacctgctggcggaaaatgtcctgataatcctcgcccatcagcgccggctctttctcatacgtgctcagtccggcctcaatgcgcatcaccgattcctgaacctccttgagcccgtcaatggccattcttccggcaccaatccactctgcccgtgaccaggctgatcgcgcctgataaaaatcaaaacgcgcccgtggcggacggataatcccccgaagaagtgcctcttccagccagtaggaaaacatctgcgtggccagccgggccgcaataaattttcgccgccccataaaatagcgccacgactcattggcagaggccctggcacttgaataactgaccttcgagtaatcacgggacaactgttcgtaggaaacgccaagaccggcggcgatataccgcagcagcgcctgttcaagcgccgaaaatccattgtctgaatcctgcgcagtctgtagtttcagatcatccccggggaaaaggtgcggaattttgacaccacccagcgtcacgttattcgtgtcataccagctggagaacttctccagaatattaataagcggattatccttctgcccctgcggcgcaccggcgatatattcaaaggccttttcggtatcaaggtcactttcaatcgtcgctgcatacatggctttcacaatggccgactgaagctgtgttgcctgcagggaatcgagcatcttcagccgttccatgacgctgtaaaactggttggccccacgggtctgcccgtcctccaccggctcgaaaatatgcagcatggccggacgcccggtgggaagttcacgcgggatccgttcccatcgtccactcccggagcgaggaaaatcatcctcacagatatggtacgcaacggcacggccatatcgatcgacctccaccccggcccgcagaaaacggttccccataccgtgtcctggcgtgtccacccgtttcggactcacggctttaaaacgcgtacggaataactgcgtggtttccgtatcccagaccggctgcacaaagatttcgccgttaaacgcatgaacgcccacaccttcacggataaattccgtgaacgtgcgttttccttccacgtcgatctcgccagacatcccttcggcgtattccgaccaggccgcctccacctcatcgacaaagctttttgctgcggtctcccgcatccccagccagcgccagttcggacggtagctgataagaaacatatgcccgacaatgtgatccttatgcagtgccaccgcattggccgctattccgttattgcgcaccagatcatctgcccgggcattccccagacgcaacgcgggcagcagggccgcatcggcactctgcgccggtggcaaccactccgccatttgcccgccaaatcctgcaccgcccccgttgtagctgagactctcacgaagcggaacgccgttcacatcaatcaggacaggcgttcgtttcataacctcactcccagcggacgacggcgacgccgggttgtccccagtaccgactccgcatcattgatcgcccggttaagctcatccagagaagccgccgtatattcaattctgcgaccatctttctggacagacaccacccgtttaccggttaataaatcaaggcgcgcctgacgcagcgcctgcagttcagcgactgtaaccattcactcctccggacagcttcgctgccagttctttcagggttggccgggtcgtctcttcttcccgggattttgccagtacagccagatcaagctgccagcgttgcacggacacacgtaatgccgcgtaggcatacaccaggcagtccagcgcttcgttacgccgctttttgttatcccacagcagacgcatctttcctttttcccacttctccaccagctcttccgccaccagttgctgcgcctctgtctgcgaaaaaatctccggatcatcaggaaaacggatggcatacgacgtggcttcatccgcaggcgagggatcggctttcatacgggcatagagaatttcttttgcggtgtccgttcccacttcacacagatacacgccccgctgattgcgggtttttggcatggtgatcaccggcttgccatagacagatgcgccttttaccggcagcacccggaaaacaccgtgtttttttgatctctgataaacaatttcaccatcgatccccccggtgtcccagcagacacgggaaatagtcatttcggtgccatccgcatggcggtattttttgttgatcgccgcatccacacgtaacagcgtctcttcctcatcaggacgccccataatgatgattttatccaccagaaaggcttcctctcccggagcccatccccagacatacatctcaaaacggtttcgctgcgagtcaatgcccgccgtcagataaaccacccgggcaggcaccgccgccgtgtaacgcaccaccttatccatcagtacctggtgatcgagtttttcgcccacggcctcttcccaggtctcgcccagcgtggtgttcacaaaggttttcaggccgttgggatctttcagtgcatccagccagtcatagacaatctgtacccaggtggtgaacggactgtacgccgtccagatatggaacatgatggagcgcggcggcggaatttcatcaccccgggcgctgaaaaacgtcagaccgtcacgggtccacatgcccgtgttttcacagatccaccgcccgttgctctggtccagttcagactgatggatcacgcagccatgatgttcacagaggtagaaaacactttcagggctgtccttctcccatttaagcccaaaaggcgtggactcatcgccaaatttcagatactgcgcctccccacagtgcgggcagggcacataaaaacgcataaaatgcgccgactcgttagcggctttttcgatctggcaggtgcctttgattttaggcgtcgagccgcgaatggattttggccacaccgacccctcaatacgcttatcccccagcagggttggcgagccctctttttcgacatccggctcgaacgaggaaagttcgtcatagcagaccacgtcaacggatttttcacggtagtttttggcggcagcgccgcccaggcaccagaaaccgacgcccgatgaaaagcgtttcagcgtgagagtattgtcacgatgtttacgacccagccatggggaaaggtctttcaggcatggcacgttccgaatcgtcgcctccacgtgagacttcataaaatcttcagcggcagaatccgtgggctgaaaaagcagactgtttcgggatttatgctcaataaaatacccgcccccccccagcaacatctttgtatagccaacacgggcagatttaatcagattaacagtgcggatctgatcattccccatactgttcatgatggcgatctggaatggcagcgttttccattcgccctcaccatatgaagattctttaggcagataataattttgatcagcccattcaactggcgtcaccggcaatgcccttatcaggggctgtaatgcagttgtgacagcgctcatcatattattcagttgttgctctgatatattcatcaagtaaatccggtaatttatcccctgcccgcgcacactgatttgcccccttagcaataagggttttcagatggtcaagatggcgcggtgttaaatcaggaaactgtcgctgcatggataaagggatggaatcaagcgtactggataacgccattgccagcttactgagggcaaaaatacagaacccggtgtcaatcagttttccttttgacacctcattttttaactgctgtgtaacagcctgttctgctgtcagttcccatctggcaataagcaatttctcctcatagtcgtcttcgctatcgccatcaggcacatcgtttttacttctcctcagatacgatatgtaaaaatcgcgccaggcatccagatccagttgccctcgcttattcgatatcggggcacccggcaatttctgcaatctgcgaagctggcgatcggtcagacttaaatgcctggcaacttcagtctgcgtagccactcctcacctcgcaaaaactctcacctcacaatcacaacaaaaccggtcatgtccggtttacatgtctgttttttgttcatgtccggttcacagaagacctgtttttatatttttcatatagttaacttgaagagaaaccggacatggatcccggaaaattttcataaatagcgaaaacccgcgaggtcgccgccccgtaacctgtcggatcgccggaaaggacccgcaaaatgataataattatcatctacatgtcacaacgtgcatctacgccatcaaaccacgtcaaataattaattatgacgcaggtatcgtattaattgatctgcatcaacttaacgtaaaaacaacttcagacaatacaaatcagcgacactgaatacggggcaacctcatgtcaacgaagaacagaacccgcagaacaacaacccgcaacatccgctttcctaaccaaatgattgaacaaattaacatcgctcttgatcagaaaggttcaggtaatttttcagcgtgggttattgaagcctgcagaagaagattaattaatgaaaaacatgctcaatttgtacccaacaaagacaaacacgaccagagcacctgttcagacaggtttacttaaacgacttatatatgacacaaaaagcgaccactaaagtcgctttttcttatggtaacaggcaataacgctctcagatattttttagcatttttttgaccgcgcgtttccggacgtattctgttctcctgtccctttatatcgtcggaatacccgccgctcttcaaatcccattcccaactcagaatgtagtctgttgaccgcttgttttatttctgtcaggttcatcggtgaaaccggagtccggcgcgccttacgcaaacactctgctcgtttctgtgccgccacttttcttttctggtcatcacttagctgtaccatcacttttgcccatcgttcagctgctctccggtacagtccttttttctccagacattctgccaggtgatcatgtagcataagtgacctccgattatctacagactgctatcctgaatttaccttcctttaatgaaataacaataaaaaataaatcacagaaaaacaacaaaacaacacacaaaaaaaccaaataataaacccaaataatcaccttattttattattttttgagagagctattactgaacaaaaaacgctgactatatactcaaaaccaaacaactattctgccaatcaggtataatggcaacacaaggaattaccgtgtttttgccttctctgcccatacaatacggacatatacttcatactctattgtaatatttccatccatgcgaacaacttcatttatctgtaaataatattcaaaatatttatcacagaaatcgtttttggccatgaactgagcacactataaagtccggaactgactctttgttaaattaccttaacgttaccagtaacaccttcataacaaaacatcacggtatacactgggtacggatatattcctgtgctccttccagttgcttctgcattgccatcagccgttctctgaggatgaaataatcccgttcagcggcttctgccagtcggggaccggttgcattatccacgccggangtgatgggggctttacgcaaggagcctggacagttggcgttgatgcgcaggcgcttacgaccagcggcaacatcagcacgcagagtttcattttcagctctcgcatcggctaattccctcgagtatctggcatcaagtgcagcgacatcacgctggcgtacctgcatatcagtaattgtcacgttcgccagcttcagctcactggcttttttatcgcgttgcgctttgtaggtaatggcgttatcgcggtaatgattcagccccagactaagcacaccacaggctaccagcaggacaataatcaccacacacagaacacggttcatatccccctcaccccaccagccatgacaaagttaagacgcgccaggcagtggaaaagcaaatagcaaccagcattagtgaaaatgaaatgccgacgattacacagaggatcttcgccagcgttatgagcttgtctgacatgcttaatcctcttcacgatttcaacgcaatgaccagttttgccagcccatacagcatcggagacacagcaataccgaccgccacccacttaatagcaaaagccagcgctctgctgacgtcatcagttacaggcgctttcagttcaaggccgtttttcatagtcaatctcaacagaattcgtttatactttcccatgttctcccttgccttactcaaggtcagaaacacaaaaccccgtttgcggccaacaaacggggttttacttttattcacttagtttttgccagttcgcaggatttcgtgttatccgccagtgtgagcaaaccgcatttttcagcaaaatattctgcttatctgtcaattccccagcacgccagcgcgctctcctggtcacgccgtgaaacctgaccgtagcagttgtttgagcgaatacggcagtctctgccaccgtccttaatccaccagcgaatcgcctcacacgctcccctgcgatcacctgcattaattcgtctgtaaaacgtcgacgggaaacacttaccgggaccaatgttgtacggacagaatgacgcgatccccgctttctggggttcggtcagcggtactttaatattgcgctccacccactccagcgccttatcacgttcaatggcgttaacctggtcgcatttttccttcgacaacttcatgcccggaacgacaggtttaccatccaccaggatggcaccgcggcagatggtccagatacccgcaccatcacggtatgccgtggtgtggttaccttctttttcgtcaagaaactggtcgaggatttcaggcgcagacgcccctgcaccaatcagcgccagaacggcagccgacaggccgtatctgatttttgcgttcatggatatttatcagggtttatcgatttcaaatccctggatatgttaaagtcttcaggccagcggtggagtcttcagagaacccgtaattattcccggtagttttcctctgtaggtatcaacacatcctgcgcctctaaaattacggggcgcttttccggcaacggaccatccccttcacataacccggcagcaacatccatgaaaaactgcttcgcctgctttttcgcctcagcttcgtaaaactccagcgtggcaccttcagtacggtcaagactaatcgccacatctggcaacaacagtgacggatacccaccaatttccggtgccacagtaacagtaatcttatccgggtaattatttatccctttaacacccagttcgtattttttcttcatcgctttactccccccgcgccgccttacgacggtcctctctgattttgaaatacaggttagtcagatacgtcagcaggccaaacagcagactccccagcacaccgattgccacccactgggacggagagactttgtccagcagctgcagtaaccagtatcccgtccccaccgctgacgtggtgtatgacacacctgttgtgattttttccatctgatgtatgtctccgtcaccgccgacagaaaatgaaagtaaaggaaaacaaaaagccgccagtgtcgcccactgacggccaacgccgggagccgtgattatggcattcaggctctgctaaaaatgccagataacattccggctcccccccctgattcaggttataaatgacacaatatcttgacaacacccatcactgtctgtcagaaaatgtactgccagatataagtatcatgtgaaacccaactatccttcttagccagtatgaaccgccccggaaatcctggagactaaactccctgagaaagaggtaaacaggatgactaaaaatactcgtttttcccccgaagtccgtcagcgggcgattcgtatggttctggaaagtcaggatgaatatgactcacagtgggcggcaatttgttccattgccccaaagattggctgtacgccggagactctgcgtgtctgggttcgccagcatgagcgggataccgggggcggtgatggtgggctcaccagcgctgaacgtcagcgtctgaaagagctggaacgtgaaaatcgtgaactgcgccgcagtaacgatatccttcgccaggcttccgcttattttgcgaaggcggagttcgaccgcctctggaaaaaatgatgccactgctggataagctgcgtgagcagtacggggtcggaccggtatgcagcgaactgcatattgccccgtcaacgtattaccattgtcagcaacagcgacatcatccggataaacgcagtgcccgtgcgcagcacgacgactggctgaagagagagatacagcgcgtatacgatgaaaatcatcaggtgtacggtgtgcgtaaagtctggcgtcagttgttacgggaaggaatcagggtggccagatgtacagtggcacgtctcatggcggttatgggacttgccggtgttctccggggtaaaaaggtccgtacgaccatcagccggaaagccgttgccgcaggcgaccgcgtaaaccgtcagttcgtggcagaacgacctgaccagctgtgggtggctgattttacttacgtcagcacatggcagggcttcgtctatgtggcgtttatcattgatgtgtttgccggatacatcgtggggtggcgggtctcatcgtctatggaaacgacattcgtgctggatgcgctggagcaggcgttgtgggcccgtcgtccgtctggcaccatccatcacagcgataaaggctctcagtatgtgtcactggcctatacggagcgactaaaagaagccggattactggcatcaacagggagtacaggcgactcgtatgacaacgcgatggctgagagcatcaatggtctttacaaagcggaggtaatacaccgtaagagctggaaaaaccgtgcagaagtggaactggccacactaacgtgggtggactggtataacaatcgacgattgctgggaaggctgggccatactcctccggcagaagcagaaaaagcttattatgcttccatcggaaacgatgatctggcagcctgagttcacagataaaacactctccaggaaacccggggcggttcagtacttctccgacgaaagtcagtactggctgtttttttattatgctgccggtgcatttatctccagcatcagactttctatctcaacgccatacgctgcattttttgtaacatccgtcagcgtcagcgcattcagtcccagtgtcagactgtcttttataacctggaatgccgggccagccactccattcagtttcggagtaaccatggcactgccggcggtgaacaccagctccagcgtctgccagtcgttaccgtaatcgccgaactcccccagcttcgtgtttccggctttcctgtgatgcatcagattcaccctgccgtcagtggtctgagtgaagtacgacatcaggaacggattaccggtacccgtcatcgccacaccatcaggaacgggagcatccgtatacagataaatccccagcccgaactgattgttggtcagtgcgcctgacaggcggaacttacaggtcagtctgccgccctgtgtcagcagggtaattgcgtcatccaccggatgcgtcagggaccaggttttattgctctgcctggtgatcttaaatacaccatctgacaactgaattccgccatccttaatgctccagccctgcgcagcagcctctccggctgccggcagcagggagattgtgcgaacggacgtatctgcagacggacccgatggcgtgttgccgccgggcgagggtttgatttccggtgccttaccactgatgaaggctgaggtgcgcccggctgcgttcagaatagcggttgccagacgatccggaataatgctcctgcgcgcccatgaactgaaatgtgtcgggcggtttgatgatacctggtttccattcgttctcgatgccgcaccgtaatatcctgatgccggaatatccggatcttctgccggcgcgttagtggcggtattgacgccgttaccgtctgtcatgaagggcacaaaataaacgccctcactctccctgtttttatacccgccgtacacggtgtcgtactgggtagcgtatgtatttttccagtaatacgtcgtgtcaccacaaatccacggcacatctgcagcgctgccaccatggcactgcgcgttaaacacggagaggtcagcacgaaactgtgtcagcatggctgtaaacagcgcaggttgctgtgcgtgggtggcggcgctcatgtcaaactcaccctgcatccagcagacggccagcagaacgtttttgggatttttctgcaatgccgcttttgtgcgggaaatcagatcctgatataacggcttgcccaccccccagcgtgccgaatcctgactggcccccgtggactcgctgaatgtcccctccgcgccctgggtaaatgccgaaccaccacgacagcatggtaccagcaggatccccgcgttattcgggatatacgggagcagttttttggcaatatgtaaaccctggccgacacagccgtactgccctttgctcaggtcagccctcggatgattcagcgtactcatatcctgcacatcatgcagacagtggtcagccggaataatatcgttatatctgcaggcagccccgcccggcgtcactgtactgcggcgcgccagctgtttaatgcgcggatccggagcatcgtatgaatccggcagcggaagcccttcaccgtaagccatggcattggactgcccggccagtacgatgacgtagtaccaatccggctcagatgaagggccgacctgtggctctccttcaatagccaccgcctgcatcagtgtgtacggcgtaatggcaaccggtccgccgtatggctgccagccctctttcagtttgtgtgtcagcttttccgcaaggtctgacggcgacgccgccctgacaacatcataatgttgaaatgtcattattcctcccggccgggatagtgtattaaatcagatatggagtgggctggctgtagtccggaagcctgaatgacactcggggactacagcccaagaaatgaaaaaaggccacgcagttgcgcagcctgataaaccctggttaaaatccacacgataacaacacaacaatatcagtatctcatgctattgcccgaacccattcgggcattttttacccataaaaaagcccctccggagaggggcatgtttgcatgcacattctttttcttgcatggtgccgggtgcctcccggtgaattcagtatcagcacctgaatccgcgattatcccatatacctggttgctgatcgcccctccgcacagggggattcaccatgcagaagtgtttttaataaacagcaaacaaaaaaatcaagcattatgcaggctgtttctttttatcaccggccacagcaataccacaatgccgcagaccagcaccccatccgccagcaccgacatgattctgctggtgaaatccaccatcaccaccagaaacagcaggagtgcagccacagccaggcgcagttttaccgtcacaggtgattctccagacgaagacccagaacaccggcaatctcttccagcaccttgcgctcttccggctcaatttcgccgtctgcctccgcaatggccaccgccacatccagcacatcttccgcttcacgcgtatcgtgtttcacatcctcaatctcgcgtaacgcggcacgacgaccaattttaaaattggtatccagctgaccgataatagttgcgctaatcgcattaatttccgaggtaaacgcagacaacgcaggctgattacgtaagacctgttcgatcttcgctttctcggatgcctcgcattcaccatctgcataggccaccaggtatgcagcgttaatcaccgcctgtgccagatcgcgtttctcaaactttttaatttccgctgccgctctgcgggttttctttttgaagattccaaacatcgtgacgttcctttgggtgggtgagccaacgcccgggagcgatctgcccacagagaaagtcacactgaccactccgtaagctcacccccgaaaggctctgtggttgatatgcgccgggcgtggcgcagatacaaaaaaggcccgccgaagcgagcctggaaaataagtgtggcgcgttgtagtggagtcgaaccactgaccgattgcttagaaggcaattgctctgtccggctgagctaacaacgcagaataccgataatggaccgccatcggggacccgcccccgcaccaacaaccctgttatggtgtcgtctgctcttcctgataagctaatggcggtttgtgatggtggcccttgctggatttgaaccagcgacctggcgattatgagtcgctcgctctcaccactgagctaaagggccgggagcagaataataacggtccgtaattaattccgcaataaaaaacccgctcaatggcgggttctggtaaagttcatgcgtttggttcgcctcgcgatacagctttgcgaagcttaccggaattgaagcagtttttacgtcaaaaagcaataacttttttctctataccaaaagccataaccattggtttgtacaaaataaattctgccacctttagccaatgctcaatgcgtctttcacaggttcttaaactccattccggatgtgcatcattcagcagttcagccattttgcgcttagtcatcccccgccccacataacgctgactcagaacattgagcagcccgggataacctgccagtacttcaccaataaccctgtcgattattaacgcctctgaatcggtacaatgcaccagccagcttttttgcttgccgttgatcatatcccgcaaaaaagcctcaagtttaggtttgtccagacctgcttttttcatcctccggagcgcctcgttaattgccgtttttgtcagctttttagaggtcagcaactggttgaacatatttcccgtcttaccgccgccaatatacgaccagcgcccccacatacgtagtttcccctgaatccagacactttccagcgtggtgagacgaaggtgctctccgctttttcctgtgttcgttgggtaaatcataaataaccgtcctttctccagatctcttgtgtgcgaaaaacaccttctgcatgcatcaggcgcaattcttctttggtgtaatcgctggtttttactctcccgtcgattaaatcgtggcatgagttacaggcaatcgctgcctgcatatcgtgtggctttatcgctgttccgcacgttcccgccagcctgtaatgcgccagcacagaggtttcgggattgtgattgcagtagccagggattctgatctggcatatctggcctttagccgctttacgtaaattcaccattacgcaaactccagtagttgtgcggccacattttcaacttcctcctgagaggagaatttacggaacagaatccagttccacagcacattcagtacagatttataaacctgctgaaactcgattcgtccatattcgcaaaagcgatggattttgcccgacgcccacggctaccgtccggataaatatgctcggtgtaaaatccggcctgaatggttacccactcgcggaaagcctcaaacgactttagcaacgccgtatcccgggttctacgagtcgcaacggtgttaaggtattgctctgcggcatcactcagggctggcgtgtgttcccgaccaactgattcgcacaggtaatcaacgaaaccagacagcagttctcgttcgcgaggcgtgatcgccccaccgaccggagtccagtaatcgaatcccagttgcaggagtttgaaaaaacgcttgtggaatgcgtagttacgcacacgcttaaaatctgcgtgtatccactcacctattttgatttgatgcagaaaatcgcaactctccggcgtcgccgggagaagtaaaccagaagaagtttgtttgaccagttgtatatgcgccatttctcaatctctcgatggcgcagtgcagcagatgccagttgttcaagctagcacgcaaattgtaaaccagaatgccaggaaaaaacaaaacccgccgaagctggttgtgtgcggttgcgttgaagtctcctagccaaagagtagcggtgaccactccccgccgataatcttagttgtttaatttcgtaagctaactaggctaaaagctctctgttgtctgcctgttgtacaattaacaaaatgaacaacgaactagatataccaacgccagaatggtgcaacaaatcccaaacaacacagcaatgcaacaataacatatgttattttcctctcacgggattcagtcctgaattctcataaagctaatctttttttaaaaacatactgttagatcacatgcactttctttcttaacatcgttgacttcgcatgcgaagcgtttaaaatcaacaatttgcacttaaggtatttatttccccacacacatagagagtaaattatgactgagaacacgactccnacagcanactttagtnctagtaaaagattttttgtaagtatgctaactcgagatatcgacttaaacgatgccatacttgatctgcttgataactgcgtcgatggggctttacgtacaataaaagacacaaaaaaaacttcaaaaccatatgaaggattttatgcgaaacttacgattaataaagatgtctttattatagaagacaattgcggaggtatccctaaaagcttccgagaatatgcttttaaaatgggacgaccccatcaaaaagaagaagaaaatgaaggcaccgttggcgtctatggtattggtatgaaaagagccatttttaaaatgggtagagattgctcaatacaatcgaataatcccgatggcgcattcactgtagatataacacctgattggatcgatggtgatggttggaaaataccgatgcacgagagtgactatgataacaaaaatccaacaggcacaactatagagataaaaaaactccattctaatgtggcacaaaaatttaatgagagcacatatcttactgatctctttttacagataaaacactcattgtcatttattattcaaaaaggatttaaaatagaattaaatggagttgttgttgaacataatccgattaacatcataactgatcattctaaaatagaaccatacatatataaagctaaaatagacgatgttgatatcgatttagttgttggcttctataaaaatttagaagatgacaatgatgatgttttagaaaaaggagttctgatgatgctggatggactgtcatttgcaatgaccgcgttgttctatattgtgataagacacatctcacaggttggggctttgctaatgtaccaaggtttcatacccaatttatagcaatttctggggttgttcgctttaccagtaaaaacccagaaaaattaccaataacaacaacgaaacgaggtgtcgatcttagttctacattgtacaatgatgtacgaaataaaatgattgaagggatgatgcattttattcgattcaccaatcagtggaaaggtgagcatcttgaagaagggaaaaaattacttaagtcagctcagtcacatgaagctcaatctttatttgaaattaccccacaatcaactccagaagataaaaaaaataactggtccaaccctaatagaaacaaaaatgagtggcgatatacacctaagctgcctaccccagtaaaaaaaagctctactgtacgaataatcttcaccagagagaaagaagatgttaaaattttatctaaatatttctttggacatgaagatgctagcgcttctgatgtggggatgcaatgctttgatacggtgattgaagaggtgaagtgatgtctggacaatacattccctatcacttaaggcataataagtctattgatagagagatttttctcgaaagcctaaacctcttaagcaaaagactaaatattcaagaatatacatatataggttttggtggtccgatgcttgaagattttagaatcatgcaaaatcgtatcgctctttctgatatgatttctctcgaagaacaagagtctactcacatcagacaaaaatataatttgccttataattgtattgattgtaagctaatatcagctcatgactttattcttgattatagtttttctaaaccatcaataacatggttagactatgcctccccgaaaaaaatacaaacggatctagatgatatacacttactaagtactaaagtaagctcttttgatattttgaaggtcaccttccccataaatcctagttcttattaccaacgtagagttggagaaagtttagatatttttaaagaagcttttattaattcattaaaatcattgcttgggaaaaagtatcttgattttaatcttcagatatcaaatgcagatctttcagatcgtaagattaaagctcttttaatacgaattattacaaacgcttttagatcagcaatagaacgtggtctttcaggacgtaaggataagattcagtattacccattatccttaaatcaatataatgatggcagtcataccatgttgacaatatcaggttttttctcctcagaacaagaatatatagagttatctaaggcatgcgacctttctaactggcaattttattcaccaaattgggaagacgtgcaagaaatagcaataccaccactaccaattaaagaaaagataaatttagatagtaaactgcctgataaagaagcatatcaggcagccgctgaagagttctctttaaacgaaaatgaacgggataactattataaatactataggttataccctaacttccaaagaattatggtttaaatattcgggctgtactcttttatttaataaattgtacagcccctttaatatatattcagcaactattggtgacacgctatttcctatttgtctgaaactatgccatttagttacatgaaagcgaaaccaatcagggaagccttgtaatctagcagcttctcttggtgtaatcactcttggatgataagggtggatcggcctgacggcttgaaagcttcctttatctctagcggttcccgcccttaaagtcgggcaaaaaccatttggatctaatcttgtagatcttgaaattttatcagtttccccaaaagataaggaagcataacgctcttggacgattttgctatgtaatgttccggtacatccagatatgatattattttttaacttagcgatcgattctgtatcaccaacattccgagggatctgcccccataatttttcataaaatcccccttttcgatcttttttaattgttcgccaactctcagagtctgattgccaattggcatcgataatatctggtaatccatacaaagcatcttttacagtaaccggatcaatcattttaggcataaatacttcatctgaaatatcaagcttcaatgatttttttacaccgataaaaaaatatctagttcgaatagttggagcaccataatcagatgcttttaccttgatgggatcaagaatatcataatcaccgctaaccaaattaaatgctttatttctaatgccagaatatttctcttgcataatacctggaacattttctgccaaaaagaataatggctgtaattctgatactaaacggtagaaatgcatgtaaagctgattcctgctatcatcaggattccccttgcctattgaactaaatccttggcacggaggaccgccaataataccatctatgggcatatcgtttttaaaaaaacccttaattatttctgcatttagtaaagaaacatcttcttggacgtgcaaacttcttggaaaattaattgcgtgagtattaatagcatgttgatcaatttcaactgccattttaacatcaaatccagcacgtgcagcaccaagacttagacctccaacgccagaaaacaaatctattacattcatatagttgcaacgtctcttattagtttctatgtattataacacaactgttcttgatgttttaaccccataagataacctcataaaggctatcccttgaaaataccggatcgcataaatttaatctttcaaaactacttgtctattaatcgagcaatttaaggttgttttagtcatgtcgataccgacatagttaactaaacccatttcatcgtccaacaaatgggggtaatacactttgatttatagtcgggtgggtttttctctatctgcctttggtgttcatgcccaaggcagatagcctcaagcacccgcagcaattctacttaactatccttttcccgcaaatcgtttttatccccagcggcaaatcgaatacacaaccagcgccaccgccatcgcaattcctaccgttgtgaatgcttcaggccaggtcatcgtgaaacatcctccacgcttataagtccgcttcgctccaggtagtccatcactttatccggcaatttgcagcccggtttcgctttcttcagttgactaaccaattgtttaaccagcattgtcaattcgcgaacttgtttcccgggctcccctttgccctgaagcagggcagcgcggcaagcgttccatccctcagcatatgtttcagttacaccatcgagatggcatgtaagcaaatccatttcttccggcactacgggcgctggaaaaacggcatagggtggcgtccattttggcgctttatctccagccgaacgctgctaccagtcatccggtttgtattcataaaaatcaccaactggctctgcttccagcgatgccagcgcaatccgtgccagttccatttgttcaccacgggtaagcccgttttcaaccggatttttaatgaacaattcaatacgttctttggtaatagtggtcatgtgttactccttaacccgcagtgctttcaactgatgaggggaacaaaatcttttcatcaaaccctgcattcatatcatgaacagcaacacaccaatccatcgacgaacgattatcaagagcctccatgatttcatccatgcggcgtaggtcatacaggtaaatgcttttatcgccaatggtgtaaaagccaatttttttcggtgatggacagcgatcaagaacttcctgtaattcgttcaaccatgcccgttctttttttgtcaaagttgccatatcagttttccttatacggattaattttattgtgcagtgtgttgaatgacgcccataccacgtcgttatacaattcaataactggctcaattatttttccgattatccagactaggattaacggggatatcggtatcatcaacacgataaacagaatgagaaacagaaattctgttgttctactctttcgcggatattttttctaaataatgtgaccattcattaccgccctttcgggcggcctcctgacattaatcgttgtgataactcatagcttcatttgcagcatcaactggatcaacctccctccagcaataatttgggtcggctccttcaggcgtccacggttctaattcattttttgccgcattctcatcgccagtaattttaaaaatctgctcagagaattttcttgcccactcgttatatttttccgcattaatggctttctgtgtatttaacataaatatacctccagttaaggattaaattttatttacagtgctgaacttaattattcagatttggattatgctttctcttcacgaagttccgattgttaatttggctcacaacagcaccttctgaaaattaccctgatagaaagccagtacacgctgcatagcttcgctcttccggcactcgctacagattatgttcagacgcctgtcgtagcggcgtatttctccgtctggtaatgaccagataagatccggatcaaccacaaccggtttcttcacctttgcccttgatagttttttgcgggcgttttgccagtctttacgcgcctgctcagacgggaataatccgtagcctgaattgtaaacatcaccactggcgaccagttctctggcgagagtgcttatgtaataccttgatgcaccggttttagcctccagagccngtaacgtctcgcgaccgctcagacgtacaagttcaacaacgtgccntttaattttttcccgctnttntggtgtaaatacttttgccataggtgcctccggcaatcacttttccgacacaatacgactggaggaatcgaaaatctgtcgaacaatatcccggtgcttgttcagctcccgcagcgcggcgcagactcgctcccacttctggacatgatttttcgcccgacgcagttcgcggtttgccatatgcagcgatggtaaaaccaggtcatccgctcgcgtttcagtaaacgatggcagcgactgcacaatgtccgccaccgtttctgttttaatatcttcctgtgttgcagcctcctgtactggtaacgcaacacctgtgggctgaggaaaggccttaccatcagtttccgc

SEQ ID NO: 97 - dna  (genomic), 494 bp; double-stranded, linear
cctctggtaacgctttttgatccgtttttgtaacgctggcagcgttaccttttcgtttcagttctcgtatttttgttactctctcgtttgtaaccgcccgttttttagagcttttcccgttatggcgctcaaagttaggaagcgacaacacaccattagtttcgaccagccatccaacctgaattaacgcatcagcaaaaccagccataaaagtgatgcgatctattgcactttttgtaacgccgcgagcgttacactctgcgttaccgtctatcatttgttgatccgcccatgcccagaagcgaatgactttccctaatgcggcatctggatcaatattcagaatctcagcaagcctgaatatttccggcttatccggcgtaataacttcgagctttatccagtttgaagccatttgttttcaccttgtaacgctcgcagcgttacatttaactgataccgaacaaaacagttcggtacgattaatttcaatc

SEQ ID NO: 98 - DNA  (genomic), 873 bp; double-stranded, linear
actcccatcagctttttcgtagtagttttatttctgccaatagttaaaattgcatcggcagaaaataatccgtttgatgcatgagcgattttttcagcgtaatttgtttcgccggtatattctgtgcgaggcaatttaccgttatccatccatttgtagattgctctttggctgacaccacaaacgtcggccacaacagaaacgcgaacagttttgattacatcttcaagtgttttctggttcatatcaccctcacaatgtgaactttgagtacatgctataacagaagtgacagtacattcaagagcgaatatcattgaacttatggttcatgaagataaagcgcgtaaagagttcgccagtaggcttgcgctagcctgtgaaaacgctggttatgaacaacatggaaggcaggcagaaattgcccgtcgaatgaaattaacaccaaaagcggttagcaaatggtttaatggtgaaacaattcctcgccgagagaaattaagggaattagcaacactcattggaacaacaccaacctatcttttgggagaggatacagaagaaagtggacagatacgtttctatcaggagttaaatccaagacaaaaaatcatcattgaccttctggacgagctccctgacagtgagacagatgaacttttaaaaactcttgaggagaaaaaacagaagtacaatgcaatttacgaagagttagcacgaaagaaaaaacaaaaagcctnttaaaccagcataaatccggtagcgtccccctccgggtttgtgcttcactttatcccgtctcatttttttatacataaaatgtacttaaagtactttacaatgatgaacacaaagtacattatatacttacca

SEQ ID NO: 99 - DNA  (genomic), 1313 bp; double-stranded, linear
tgaaccgccccggaaatcctggagactaaactccctgagaaagaggtaaacaggatgactaaaaatactcgtttttcccccgaagtccgtcagcgggcgattcgtatggttctggaaagtcaggatgaatatgactcacagtgggcggcaatttgttccattgccccaaagattggctgtacgccggagactctgcgtgtctgggttcgccagcatgagcgggataccgggggcggtgatggtgggctcaccagcgctgaacgtcagcgtctgaaagagctggaacgtgaaaatcgtgaactgcgccgcagtaacgatatccttcgccaggcttccgcttattttgcgaaggcggagttcgaccgcctctggaaaaaatgatgccactgctggataagctgcgtgagcagtacggggtcggaccggtatgcagcgaactgcatattgccccgtcaacgtattaccattgtcagcaacagcgacatcatccggataaacgcagtgcccgtgcgcagcacgacgactggctgaagagagagatacagcgcgtatacgatgaaaatcatcaggtgtacggtgtgcgtaaagtctggcgtcagttgttacgggaaggaatcagggtggccagatgtacagtggcacgtctcatggcggttatgggacttgccggtgttctccggggtaaaaaggtccgtacgaccatcagccggaaagccgttgccgcaggcgaccgcgtaaaccgtcagttcgtggcagaacgacctgaccagctgtgggtggctgattttacttacgtcagcacatggcagggcttcgtctatgtggcgtttatcattgatgtgtttgccggatacatcgtggggtggcgggtctcatcgtctatggaaacgacattcgtgctggatgcgctggagcaggcgttgtgggcccgtcgtccgtctggcaccatccatcacagcgataaaggctctcagtatgtgtcactggcctatacggagcgactaaaagaagccggattactggcatcaacagggagtacaggcgactcgtatgacaacgcgatggctgagagcatcaatggtctttacaaagcggaggtaatacaccgtaagagctggaaaaaccgtgcagaagtggaactggccacactaacgtgggtggactggtataacaatcgacgattgctgggaaggctgggccatactcctccggcagaagcagaaaaagcttattatgcttccatcggaaacgatgatctggcagcctgagttcacagataaaacactctccaggaaaaccggggcggttcaaaa

SEQ ID NO: 100 - DNA  (genomic), 883 bp; double-stranded, linear
agtttccaccaaattttgatgagtcaaaacagtatccggcgattatcagcgtccatccttttggcagttgtaaggagcagacgtctggcaatatctatggcaaggcattggctgaaaaaggctatgtcgttctcgcttatgacgccagtttccagggagaatctggtggggagcctcgttggatagaagatccgacacagcgcgtagaggatattagccgtgttatcgattatgcagtaactctgccatatgttgatgctgaacgcattggcgtgctgggtgtgtgtgggggggggtggctatgccattaatgccgcgctgacagaaaaacgaattaaagctgtagtgagtattacgggtgttaatatcgggcgtctttttcgggaaggtttcagcaattacgatccgattggcgcattgaatgcaatggcgtcgcaacgaaccaaagaggctcgtggtggagaattacagatcaacgaattacttcccgccagcctggatgcagcaaaagcccatggactgaccgaacgcgatgtttatgaagcaactgactactataaaacaccacgcgggcaacaaccgggaggtgcgacaaaaatgttgttctcacatgcacagaaaacgctggcctgggatgccttcgcatttactgaagtgttactgactcagccggtgatggtagtagttggtgaaaaagtcggtgccttcggtgcttatcgtgatggactggaagtctatggccgggcgatggtttcgcaggatcgtcagttagtttcattacccgatttctcacattatgaactgtatgacaaaccggaagcagttcaggaggcgctggaaaaagttattccttttttcaacacccatctgtgataagtttcat

SEQ ID NO: 101 - DNA  (genomic), 665 bp; double-stranded, linear
agccagattattatgggggatgtactgaatcatgcagcactgaagcaggccatgcagggacaggatattgtgtatgccaaccttacgggggaagatttagatattcaggcaaattcagtgatcgctgcgatgaaagcctgtgatgttaaacgtctgatctttgttctttccctcggcatttatgatgaagttccaggaaaatttggcgaatggaataatgcagttattggtgagcccctaaaaccattccgcagggctgcggatgcaattgaggcttctggactggaatatacaattcttcgccctgcctggctgacggatgaagatattattgattatgagcttacctcacgcaatgaaccattcaaaggtacgatcgtatcacctaagagtgtcgcagcattaattacagatatcatcgataaacctgagaaacacattggtgagaatataggcatcaatcaacccgggactgatggcgacaagccattcttcatgtaaatcaattatataaccaccatcgtactgtactatgtgcagtacgatttattaaacttattaaggtgaactgatcaatcagatgcgattaacatgtgtagaaccagtaagaataaaatacgccatgtatataacattacgacaattctaatatctgcacatcaatg

SEQ ID NO: 102 - DNA  (genomic), 7886 bp; double-stranded, linear
cacctcatcctgacaggggaacccccctcaggatgaggtattcattacttttgattgtcgattctggtgagagcaaccaggaatgccagtgtataacacaccgtaattgccagactcatttttaacagtgtttctccgccaaatcccgacaatggcgcggctataccgccgaagacaaacatgctcatccccatcaacgcagacgccgttccagattcctgcgtccctactgcactcatagcctctgccccgccaacagtgccgatgccgctacaaaatgcaatagtgaaaaataatgccaccagtgccggaatgggcaattgtgtccatgcgcataagaccgtgagcaatgcacacaaaattgccgctatcaggccacctcgcaacaatgtcatcgcattaatccgtcgcgccagacgcgaaaagatccatgaagcaatgataagtccgatgccgttaaggccaaacaccaggctaaattgcattggactaaagccaaattccttctgcaacacgaacgacgaagagccgatatacgcaaacaagcctgccagcataaaactttgaatcaggcaaaagcgcataaaacggcggttctgcaccacgcttcgtccggttaatagcaatgatgagccccttttattttctggcaaggtctcattaataaataacacgcagcccagcaacaatacggtgctaatttcagccattacccagaataaagtgcgccagtcaaaagtgctaacaatgtacccgcccagcactggcgacaacaccggtgccaggccattcaccgtcattaacagcgcaaaaaactgggtcaacgttactccctgatatttgtcacgagcaatagaacgagagagcaccgaaccacccgcccccgcgatcccttgaataaaacgccagaccaccagccagtaaatattgttcgttgtcgcgcacaaaatggaagaaacaataaacaatagcaacgacaagattaacggacgtttacgccctattttgtcgctcagagggccaaataacagttgtccgacgccaagaccgatcagtgatgcagtcagcgttaattgcgttatggtcgtggttgccgccagttgctcagacatctccggcaaagccggcaaataaagatcggtacacatcgggccgataccggctaaaagaccaagaatcaatgcccatgaaagagagactctagccatattattccttacttgagtgatgacatgccgccgcccagcgactgccagagcgtgattcggtttgtaaaatcagtcagttgcagtgccagcagctcctgctgtgcgctccacaagctgcgctgcgccgtcaacacggtcaggtaatcaccaacacccgtctgatagcgacgcaagccaacatcgaccgtttgttgctcagctttaacatactggcgctgtgcatccagttgctcttcaagcgtggtccgccgcgccagtgcgttagcgacatctttaaatgctctctgaacggttttttcataggtggcaatgagtccacgcttttgtgcttctgcgtaacgaagctgcgccagattacttccgccagtgaacagcggtaatgtgaccgatggcgtaaatgaccagatctgcattccgtggctgaacaacgacgacaatgcgtcactgccaacaccagcgctggcagtcagcgaaatcgtcgggaaaaagttagcccgcgccgcgccaatatcggcattggcgctcttcaaattatgttccgcttcctggatatccgggcgacgcagcagaacgtcagatgacactcccgcaggaaccagacttatcatctgttccggcaggctttccagtgttcccggtagcaaattttcctcaagcgttgtacctgccagtaagttcagcgcatttttatcctgcatcacttgtgtctgatagctggcaacgctggcgcgcgcttgctgataaacactcatcgcctcactgacatctgtcgctgccgccgtgccaacctgttgctggcgctggataattttcaatgaattttctgcactggtcatcgtttcttttgccagggccaggttgctgttatcggccgccagtgtcagccaggcggtgctgatttcagcaatcagcgttaaacgggtgttctgggctgtaaattcactggcaagccaggtttctcgcgccgcccgagataaactctgattacgaccaaacagatctaacgtaaaactggacaccgtgccgtcagcctcggcagtggtttccgtaccattcgccagcgaacgactgcgggttgaacttaaggccgcattcaccgtcgggaataacgacgcattagtttgcccatagagcgcccgtgctgagtcaatatcagcaatcgctttttgcacatcgcggttactgttcagtgcaatagtcaccacctgctgcaatcggggatcgtggatcacctgctgccagtcatggctgattgcctttccctggccctgtgctcccggcaaggtcgccgggattggggattcaggcgtgctgtagtggggatcgagcgagacacatcccgcactcaacagcaccagaaaaataagagaacgacgcaacataacttactcctgacggcgcgatttaccggcaaacaaacgcttcaccagtacaaaaaacagaggaacaaagaaaatagccagcaacgtagcggtcagcgtaccgccaataatgcccgtaccaatggcgatgcggctgttcgcccctgagccggttgctatcgccagcggcattaccccccgcaataaacgccagcgaggtcatgatgattgggcgtaaacgagtctgcgccgcgcgtaatgccgcacgactcaaggaataaccctctgcaaccgccgcttcagcaaattccacaatcagaatggcgtttttcgacgacaagccgatagtggttaatagcgccacctggaagtaaacatcgttgtttaaatcacgcatccaggccgccagcgccgcgccaagaagccccagagggatcaccagaatgaccgagaacgggactgaccagctttcgtacagtgctgcaaggcagaggaaaaccaccagaatagaaactgcatacagactcaatgcctgaccgctggccagtttctcctgcaatgacaaaccactccaggcccaggttgttcccgcaggaagactgtttgccagttcctccatttttgtcattgcatcgccggaactaaagccagtcgcattttccccctgaatttcataggctgcagaaccgttgtagcgcaccagtctttccggtccatacagccagcgggtggtcgcaaaagcagagaatggtgtcatggcgttatcactaccgcgcacaaaccatttacctaagtctgacggcgcggaacgaaattcactgtcgccctgaatgtagacttttttcacacgaccacggtcaataaagtcattcacataagtaccgccccacgcactggacagggtgtcggtgacatcattcaaactcaaccctaatgacaccgctttattactatcaatatctacctgcaattgcggcatttgtggcaaatcattggcacgaacagaatgtaactccggactttgattcgctttttctatcaactgattacgcatttgcagtagtgtttcgcgatcggttccaccgttagctaacaattcaaacgtaaaaccattgctttgccccagcccatcaacggctggcggcgtcatcgcaaataccgtggcatcacgaattgtgcccagctctttggttgcccgtagggcgatagcctgggcggtgttttctgcccctttacgttgagaccagtttttcaacgaaacaaacgccatcccggtgttctgtccgctgccgctaaaactgaaaccatcaacggtaaaaatgacatcggtatttgctttctcgttaatcaggaaccagtcaacaatctggcgattcacttctgctgtacgggcagcggtcgccccggccggcagcgtgtactgcaccatgatttcgccctggtcttcagtgggtaagaaactgcccggcagtttccacatcatcagggccattccaccacccagtacgagataaagccccatcgttcgagcagcacggcgcaggacataaattacgcctcgctgatatttatcttcagtacggcggtaaaagcggtcaaatgcgccgaaaaagccttttttatgtggcggaacatgctggaggacggaaccgcacagggcgggagtcaaggtcaatgccaccaccacggaaagcagcattgcggagataatggttatcgaaaactgacgataaattacccccgtagatcccccaaagaaggccataggcaggaatacggctgacaacaccagcgcaatggcaaccagtgcgccagaaatctcgcccattgatttttccgtggcttcacgcgcgggcaaccctttgtcacgcataatgcgttcgacgttctccactaccacaatggcatcgtccaccagcaagccgatcgccagcaccatagcaaacaacgtcagggtattaatcgaatagccaaacaacgcaagaacgccgaatgtgcccagcaaaacgacggggacagctaacgccggaatcagtgtggcacgcaggttttgcaggaataaatacatcacgcaaaccaccaatacgatggcttcaaacagcgtctgaattacgtcctctacagagattttaataaattcagtgctgtctttcgggtaagcgatgtcgtatccctgcggcatgttccgctggaattcggcaatcttatccttgaccagcgtcgccgtattcagcgcattcgcaccgggcgaaagcattacagcaaccccggcagacgggtgaccgttaagtttgccgatagcggtataatcttcactgcccatctcaacgcgagccacatcttttatacgaacaactgcgctgtctgactggcttttcacgataatatttttgaactgatccaccgtctgcaagcgagactgcgcacgaaccgttgcggtcagttgctgagtattcggtgaaggcaatgcccctattttcccggcagtaacctgcacgttttgcgcttcaatagcactttgcacgtctgaaggcattagcgagtaagacgccagtttggccgggtcaagccagatgcgcatagcgtattccgcgccaaagacttgcagactccccacaccttcaacacgcgccagcgggtcctgaacgttactaaccaaccagtcggcgatatccgaactggaggctttgtcagtggtgtcatacacggcagcaatcagcaaaaagttgctttgtgatttctccaccgtaacacccgtttgctgcacttcgctgggtaggcgcgactccgcctgctgaattttattctgcacctgtgcagtatctggatcggtaccttgttcaaaggtcacattaatactgaccgaaccatcagagctgctggttgagctgaaatagagtaaattatcaagcccagtgagttgttgctcgatgacctgagtcacgctgttctccagcgtttcggcagaagcaccagtataagtggctgaaattttaatggtcggtggcgcaacgtcaggatattgcgcgacgggcaatgtgcgaatagccagaatccccgccaacataatcaaaatggcgataacccaggcaaagaccgggcggcgaacaaaaaagcgcgaaaacatcaggcgttgcctccattagcctgaacttcaacagccttgaccgtctgccctgaagtgactttggcagaaccttcaacaatcagtcggtcgccgctgtgcaggccgtttagcaccagccatttatcaccatatgtttctcccgtttcgagcgttcgctgctctactttattgtctttattcaccaccagcgcagttgcattgcctttagcatcgcgcgtgacgccctgttgcggcgcgagaatagcgtcttccatcacgccttcatcgacacgagcgcgaacaaacattcccggtaataattgctgttgtggattggggaaaatcgcccgtaatgtcaccgaaccggtagactcatctacagcgacttcggtgagttccagacgccctttttcgctgtaggttgtgccatcttccagaataagtgagacgctcatggtgtcactgttggtcgccagtgactgtttacgcagacgtaataaatcgacactggagcgagtgaggtcgacatacattgtatccagaccacgaatagtcgttaacgctgtatcttgcgacgcggtcaccagtgcgccaggggttaccgacgaaatgccaatgcgccctgaaatcggtgcggttaccgtggtccagtcaagattaatgcgcgcagtttccagtgcggcttttttcgccgctacactggctttatcttgtgcacaggtagactgagcatcatcagcatcctgttgtgaaacaccgttctctttcaccagtcgggcataacgctgcgctttctggcaatcggcttttaccagtgcctgtgcttgttgtaatgctgcccgagcttcattccatgcagcctgataactggccgcatcaatctggtagagcggctgtccagccttgaccagatcaccttccttaaataagcgtttctggataattcccccaacctgcggacgtacttcggcactgagcgcagcactggtgcgtccggttaattcactgactaccgagaccggttgagatttgactgtaacaacgccgacttctgtttctgacggggatgaattgttactttgcgtattatcacaaccagataagagcagcattgccactacagatgttgctatatacttcattattttctccagggtgagaaataccctcctcattaaaattaatgaggatatgtcagggatattcagttataacgaacccgcatcgcgaaatgaatttcgcaatgaaataagggggattaatatcccccgctattggttaattctgttcttatttatttatcaacatactaacaatatcctgatatatttcctgcagatgttgtggatcgcttttttgcggtgttaaacgacgataaaccgtaccttccatcatggtagcaaacacttcaacgcagcaacgaatgtgctcctcgctaagatggggatgcattcttttcatatgtgcacaaccgttagcgaacattctggcgtcagcttcttcaagcattgccataacccgcgggttgcgtgtggcttctgcagccacttccagcatcagcgcgtcgtcgtcctcatttaaggatttacgcaaggcaaggacttccgggaagtgatcggtacgcgcgtcaatgtccatttgggcaatacgaaagtcgatgatacggcgaaccatctcttcaataatggcgtctttgttggcgaagtaacgatatatctgacccacgctaagctgagcttcgctggcaatttgcgacatactggcggcatgaaacccgcagcgacgaaaacaccgacgggcggcgttaatgatttcatcctgacgctgtttgtggcgtatttccagcttgctggtcatttctgtctcctggcctatcacttggtgagaatgatcgttctcatttttgctgattatacgtttctccaaagtaatggaaagtatttttatcttattcatggtgcatattctgataatgaagagattgtggagattctgtgaagatagttgacaatattaagttggggtcaattcatcagaaaggctgctacttgttgtcgccagttctgttttcatcatcaaacttatcggagctaatacgaatagtttcatagtcagattctataagatatttccccaacctaccccttgcaggcgtcaagagtagataacgcaaaatgctctgtaccgcagcttctctccggtacagaaagc

SEQ ID NO: 103 - DNA  (genomic), 3946 bp; double-stranded, linear
gtagattttacaaaactcaataacatattatatttaaaggaaaaatacagaatttacgatgcttttttatacagatctctcgtgtttttaactgattgattttgttgaactctttttttgttttgcaggagttactcctcttaccttattgtccactcgatgaccaacacattcacaacccaaaccagaatatcctatctatgaagcatgtatccgcacgcagattaattatggtttacattgttctaccacaatagtcgcatcctaaatgggtgcggttgaggatcaccatccttgaagaggatgcccgccactttaactgcatgacagggctatttaaacaatcactaaaaatcgcccaagagcattctgtttctataatgtattccaagagattaaaaaataatatcatacgttattcggcagagttcgtatgtactacggcgtcccaaccatgtcccaaaacaaaaatttctgccctatacacgttccaaaaaattcaacagcaaagagagtctgctgacgagttgttgattcactgattaatacgtaaaattgataactgctggaaatcatacaatactcgtactttcgaaagttcgataaccaggtgctacacgcgaggggttgcaggtttctttacgatttatcattcaatcctaatccatgcatgacatgtggtgcctgtggggtgatcctacctacgtaatgtggacacagccctaatcaaggttctgtttttcaaaacagttccgtgctgagacagccacaagtactgtgtcggcaccaccgattgtaatcacactagatctaattaaacacagccgctgcattatttcccgactcataaaatattagccgtaaatgcattcgacttttagtgagtggaagaaactttccgcctagcattatcgtaacagcgcccctttgcactcatcctgtcatgcaggtatgccgcttcagaagcgcctgataatgcgttgaaatcaggacggtggctacttgctattcagttcacgatacatcccttaaggaccagcgaatagcaatgagtcactttattatcaagtttgatgaccgctttgatgctaacttttaataagagtctcttcacacaaaatcgtgtaccgagtctacactgaataacaatcactcctcaccgtaaagtgaccgatactgcaatcaaactcacactgctctctggccacaagcattgataatgttattggctctctgcttagtgggtgatgcatcccatcattaattatacgagaaagagccatttcatcatataaactacatactctggaaccttcagcatttcttaaaaaaacacctcgttgaggaattgccagcgtaatcgggcactgtaatgcttcatctatgtaagacatttcttcaatattaactaaaaatgaacatgaatgtaatcgccgctgtaacaattcaattctgttatcattactatgcataaattcagaaataacctgccccatatatgtactgaatacatcaagaaatgaattgcctccattcaattgattttcaacagaatcagccaatctaatgatatcggctagttctgtatggcttaaacccgaatatagttccccttgaacaggatctacaataaaagcgtccatagcactctgatagcgaacagaaaacgatcattctcctattgtgagtctttccatttgatgatctctggtcgcacgttgtaaaacttcaacatcttgtgttgacaagtaatttccagaagacaaattaaatgaaaatggcataattttatccctaaagcatatatcttacttttcgataattaacaaaaagccatcctccacagcaatactccatcagaataattgtaggattattttaatctaatttataagcataaaatatatactcactaaatagctgcgcagaatagtagatcatttagagggaactcaacccgattgtgcgatctgatcaatcgccaaatcaatacaaatcaccaaccggactgagcaatgtcgatcataccaccaatttcccgtgacgaacgacgcctaatacagaaagccatccataaaaggctgacagccatgctgatgctgcaccggggcgaccgtgtcagcgacgttgcccgcacactatgctgcgcccgttcctctgttgggcgctggattaactagttcacacagtcgggtgttgagggactgaaatcattacctgccgagcgagcccgccgctggccgtttgcgcatatctacacactattacgtgaacaggtaaaatattcactcgcgactttggctacaattattcacgctggagtacagaactgctgacaataaaaatcaatgagataaccggctgcctgttacatgctggaaccattcgccgctggttgtcgtctgtggggcttgtgtggcgaagggctgcgccaactctacgtatccgtgccccgcctaaagataaaaagatggcaacaatccataacgcactgacgaatgcagcacagagcatccggtcttttatgaagatgaagtatttatccatcttaatcccaaaatcggtgcggactggaaactgctcgggaagcaaaaacgaggggtcacgccggaacaaaatgaaaaatattctctggacgtagcgctgcacagcgggacaggttaagtcagctgtgtgggcgccaacagcaaaagttcggcgctgttcatcagactgctgaagcggcttaaagctacatactgtcggacgaaaaccatcacgctgctcgaggacaactacattttccacaaaggccgggaaacccagcgctgggctgaaggataanccgaagtgcagagtcatttatcagccgggtttaatctccatgggtgaatcattttgaatagctatggcagatacttcacgccacaataacgcgtaatcatcagtgccgctcaatgtggcaactattgaaaaagttcgccattttatggaatccgtcagtccattccccgaaggcaaacatgggctggcaaaaatgtgcgatattaggcgcagctatttagttattccgtcatttctcccgcccgtgtaaacactactgaatcttgtcgttgtgacaaagctataaatagtcaatcacagcacgtttctgcgtacgacgcgctgcaattttctttacgatttataactgtacaggtgaactatgagttatttggatacatacatatagtgtaacgcctgttgtatattttactcatatctttttacaggatgaaaaccaatgatactggcgcatagcctcctccaaccttacccctgtataacacgactcatataacctgggatttcatttcgtagttttacaatatcaacacccggggcgatatgtttctgataaaacttgtctgcaagcacgtttgctatgtaatctgttgtactgttttttacagctcggctcataccatcgcaaagagcatccatttttttgccaaaagaagcatttcctattattatatgattaatagaactttgtgccgctttaacatcaagagttagttcaaactccttacttacaagagaaaagaccattttcctctcttcagaagaaatttttgcatttttttgaaggcagcaattatcaatctcttggttgataacccttgacggatatactgtccgttcatcacttacccatccatgaatatctttagtactctgcctgcttaccgtctccagtatacagccgctaaatttgttaacattaaagcggatagagcgctctcccattgaacacttcacgacctcatcattcttcccacggatggtgccccggaaagaattatctttatgataactgataccaaaagagctgaaggacacacctgtcgcatttactggcataacaaatccttttcattaaaatttgcttacaaaaattgtatacaatcattttaattaaaaaaat

SEQ ID NO: 104 - DNA  (genomic), 6232 bp; double-stranded, linear
cgcgtaagaggctaacctacatgtgtctagcatgaaattggcctcagattaatgttaggcgtcttgcaggacgcgtaatgttaactggggcttttctctgtctgccttacggtggcatgcccgaggcagacagcntcaagcacccgcagcaattctacttaactctcgctttaccgcaaaccgtttttacccgatatgggaattcccatatcgtaatgaattcagttccctagtcgatccatcaaaaacacaaccaggcagtaaacgcccacaacagcaataacagccagcgcaccttccattgccagtgaaatatcatccgacatattccctcctttggtgtgaatcccggcgaacgtttttacccccaccgacaaataacatatactaaaaaatcaatagctatagcaacgcctgtaattgcaaaggcttcaggccagatcattggcgcacctcctgcggcggttctggtagcggcatccagtcggttacattgcggctctgtgtttcgaaaaattcatcaccattacggactacatcaaaaaactcaccgtctcgatattgcgcataaagaacgaatgcgccatcacataaaataattacgtgctgaccatcatccggcattcgctcactacagcttatccaatcatccagagttaccggatagttggttgacgtttccgagatttcccgaaaattattggttgacgaaccctttttttcccgaaagtttccagcctgaagcatggcggcgctgtctggcggggcagcatatagcggcacgtatatttccggttccttatcagcaccgggttgctcttccagtgagaatgtctttccggtaaatcgattcatataaagcacgggctctgcttccagcgaagcctgagcaacaagggccagtgctaaatccaactcaattgcctcgagagaatttttgaatgctgtctgttttactgcaaatttcatcgcctttacattttcactaacatgactgattaactgctcttttgtaaaagtggtcatctcattctcctttgatgcgaatgccagcgacaattgaagcctgatagctaattcactcacagtaccgcctcctgaaaattgccctgatagaacgccagtacacgcagcataacttcactcttccggcactcgccacagattatgttctgttgtctgtcgtagcggcgtatttctccgtctggtaactttcgaatcaatgtctggtcggttgctttctccgctgccttacgccatacgcgatacacctgttctgatgtaaaaacaccgtatttaccgggcatgtataaatcgccacaagccagtacatccacaaggcaacgtctgactgaatgccagcctgctcccgtcgctctctccagttgtgatatcgtcatgcgttcatttttgcgtaccagcccgataattcgggccttcagttcttcacgctgttcgtgtgtaaaaggtttcgccataagcgcctccggctatcacttttccgatacaacacggcgggaagaatcagtaatctgtcgaacaatatcccggtgcttgttcagctcccgcagcgcggcgcagactcgctcccacttctgaacatcacttttcgccctgcgcagcgccaggtttgccctgcgcagggacggaaaaatcagctcatctgcttgcgtttcggtaaacgatggcaacggctgcacaatgtccgccacagtttctgttttaatttcttcctgtgttgcggcttcccggactggtaacgcagcacctgctggctgaggaaaggccttaccatcatttttcgttaccggcgcggctttcggatctgctggtaaattaccccccgacatgcagtaacgaaatttaccgttctgattaacgcgtgccagccgccccgttgcggttaccaccgccagcgtggaagcaaccttgcgagtactgacgccgaacttacccgccagttcctcacacgttttagcaccatcctgaccgataaactcaaccatcatgtctgcggtaacttttggagcgacctcttcggttaccacatccggcgcttcaggttgtagtgcctgcccttcggttaccccggcttcaccttcgacagccagaaaccaggtgtgacccgttttatcaacaacgccatttttttgagttcccacagttcgttaagaacttcttcacggctgatatcaagccgcgccgccagttcaacagaattggcttttcccatcgctttcagtgcatgcaatacagtttccatcgaaaatttacctcgtcaaaaattctcacataccctgacgtccaacgtttgaccgccagctctcccagttaaaattcacccaacgaccaccattcatggtcatacggtccatcacccgatctccgaggagtgtgctcatcgctgcgtgattcaggttcgtcagcattccgacactacgcatcgaagccgttctgcggtcgactatctggttcagcgtgacctgctcgttgcgcgtatcccgctgcatgccaatttcatcaaggaccagaaggtcaactccacaaagctcctgtaaaaatttttccccggactggccgttgtcgtagccgtcatgcaacacgctcatgacatcggacacggtgacgataatcacgcttctccccttcgccatcagccgattgccaatcgctgctgccaggtgatttttaccggtaccaggtttaccgctgaacacgaagtttgtacatccggtcatcaattcatcggcaatggatttcgcctggctcagagcatggcgctgaccgtcgttctgcacccggtagttcccgaatgagcacttcctgtgaagcggctggatgcccgcacggttcaggattttttcaacccgcacctgatgattcaggcggttaatctcctcgctgcgttttcgtccttcagcaagttgccattcccgccactcctccaccgtccggtacggtggaaccgccccctgtggtgcaagtctgcgaatacgttcaagaaccccaactgccgcaatgtttttcatgacacgtcaccccctgaatcccggcggtatttcagtgtccggttcagaaatgtgattcacgcaacgctgcgcgggcgaacgccccaggcggataaccagttcatcccatttttcccggagttttgccggactcatgatgttttttacccagaacgaatcccgctggagacgcccaaacatttcacaaatttgtctgtgagttctgccatccagcatccgcattgtccgcacgtcattggcccatgcagtccagttgggttctttcggtctcgtgatctcgccatcatcgctggccgcctgctcgtaaagactcacgattcgtccccagatccactgtgcgcacaccaaatcttcctgacttccccactggcgttttttcgcactgaacacaaccgcgtcagggtgtcgggttaaaaaattctgttcagccgtctgcgggtccggttgcgaagcgtccggacaagaagatcttttatctgacggatcaggttttaatactgacggatcggggtcaatcatcgcccccctaatcggcagtttgttatcaacagttgatccatcaaaatttgacgggtcaaccgttgagggggcaatatttgacgggtcaactgttaacgggtcattttttgccgggctaatttttcttttcggtttatatgactcacgcgccgccgcagcagctgcttcgagtttttccacattaagccgatagatattgcttacattacgcccaccgaccttacgctcttccttcgtcagccagccctctttcgccagttctgcaatagccgatttcactgtggattcacttcttgcaccgatctgacgccggatagtttcaatggcaggccatgacacgccctcgtcattgctgtagtctgcaagacgggccataaccgccaccctggataagatcatgccggtgaaggcgcacccttcccagacaagaccatgaagcttgctgctcataaaacccccgaacaccgtgcttttagtgcatcaccacagcattccctgccgggccgccgcgattcatctggtcatacaaaacaaccgctgacgcaacaaaatcatcgacatccttcaccagccgatccctccgttcgacgatctcacggtaatattcagaactgtggctgcgcatacgggccaccagcaaaggcggcatcgccttttcgatcgccggtaacagagcctgcattttttcaacagcatcaggggtgtctttatccagccaacggaaaattttctgggtattacgggccagggcttccggatggctgtcgtcatacagttccgggaacgtcattcccagctcgaaatacgctttggtaattttcgcagccggtactttttcgccgtccggatgcgcccagacattcatcgccatgcggatgtgttcatgcttgattttcatgaatcaactccatcagataagcatgcactacaatcaccttcagcatgaactacatgtgtttgccccaaacgaatgccgctcgcatactcaggccaaataagctcccaatcatggggtcgtagctccgccctacttacttggccttccgtcgcagattcgatcataagggcgcgggttggagatatagctgttcgtccagacgccatttgcgataagtaagatggcgatacaccaagtctggccgcgaatttcttagcatcaccaacccttaatgatttaataaactcttttaatgtcataccttcctcggtttagtgtttttttgcgagtttagtgtttaataaaccattaagtcaagtatttgcttgtttagtgattactaaagataattaccacatgcaaaaaaaagaaattcgccgtttacgtctcaaggagtggtttaaagataaaactctgccacccaaagagaagagctacctatctcaactaatgagtgggagagcctcgtttggagaaaaggctgccagaagaatagagcaaacatacgggatgccggaagggtatctggatgcggaatacgcagaacaaccggggggttctccaccacatgcagggttaacgtctaatcaactggaattattgcagattttttcagccttccctgaggatgagcaacgccagataatcagcgagttaaagcagaaaaaagaatcaatggaagatctcatagcgagatggattgcggcgcaaaaatgccgccgcgcctgagttataaaaccggaggaaacatgaatagagccctttcaccaatggtttctgaatttgaaaccattgaacaagaaaacagttacaacgaatggctgcgtgcgaaagtagcaacgagccttgcagatccgcgcccagcaattccccatgacgaagttgagcgcagaatggcagaacgctttgctaagatgcgcaaggaacggagcaagcagtaaaatgttacccgtgttatggcttgaaagcgcagataccgacctagatgatataactagttatattgctcgtttcgacatagatgcggctgaacgcttatggcagcgattaaggggttgtgtgctgccgttatccgaacatccgtatttatacccaccaagcgacagagtacctggcttgcgtgagattgtagcccaccctaactatataattctataccgcgtaacaacatcaagcgttgaagtagtaaacgtgatccacgcaagacgccagtttccctaactttcactaccaatagaaacataacaaccgcaacgactttatcaaaagcgttgtgtttgttatgtcccgcggtttagtttttgcttgacttaagtttaatgtttattaaactaaaaataccaacccaccccgccccacagaacgcagggaaatacttcgagttacccggcagtggtcaggggttaagtagccagcccgaggcgtatgaacatgacggcagggttcaactttaataactatgcagcagttttttgttccgctaccccggcgttaaggggaaacagagggtttctcagtgggcgaagtcaaacatcagaatggaaggcatcccgggatcggcaaagaagcagcaatggcgctttatattgacatcagcgccattgcaggacaggtaagagttatcagagcggtactaagcggtatgcgcctttacttcagaaagtctctggtgagtgcaccgaagatattgtcaacgatttcgtcatcgaactgcgaggactcatcttcagttacaaggtgaccacaa

SEQ ID NO: 105 - DNA  (genomic), 1711 bp; double-stranded, linear
cgctggctgccggggctactgaaatcacaaaagaagaatattttgcccgaaaaaatggcacatacacaggcttaccgcaaaatgcaaataccgcacaaaattctgaacaaccagaaccggtaaaagttaccgctgacgaagtaaagaaaattatgcaggcagccaatatcagccagcctgacgccgaggaactgcttgcagtatcacgtggtgaatttgttgaagggattagcgacccgaatgatccgaaatgggttaaggggatccagacccgcgattctgtgaaccagaaccagcaagaaacggaacagaacgaccagaaagcggaacaaaacagcccaaatacgcaacaaaacgagccagaaacgaaacaacctgaaccagtagtgcaacaggaaccggaaaagatctgcaccgcctgcggtcagagcggtggcggcaactgccctgattgtggtgcggtgatgggtgacgcaacataccaggaaatattcgatggagagaatcagcctgaagttcaggaaaatgatccggaggaaatggaaggtactgcacatcagcacaaggagaacactggcggcaatcagcatcatgccagcgatagtgaaactggcgaggcgtcagatcccttaattaaggcgaacggtcatcataatctcacatccaccagcagagcggggattcatctgatgatcgatcttgaaaccatgggaaaaaatcccgatgccccgattatctcaataggtgcaatatttttcgatccgcaaaccggagatatgggaccggaatttagtaagactatcgatctggatactgctggcggagtcattgatcgggacaccatgaaatggtggcttaaacaatcacgcgaagcgcaatctgccattatgaccgatgaaatcccgttagatgatgcactgttacaattgcgggaatttatcgacgaaaactccggtgaattttttgttcatgtctggggaaatggagccaacttcgacaacacgattttgcgccgttcatacgaacggcaggggagcccctgcccgtggcgttactacaacgatcgcgatgtacgcacaatcgttgagctggggaaagccatagacttcgatgccagaacggctattccattcgaaggtgagcgccataatgcacttgatgacgcccgttaccaggcaaaatacgtttcagctatctggcaaaaactgatcccgagtcaggctgattcttaatgttcaactgtcgccggttgtgactggtattctgcaaccggcgctcgtctgatgtaagagataaagaaatcgatgagcgaagtaatcatgattgtctctcccggcaaatgggtatccgaagagcagttaattgcgctgaaaggaataaaaaaaggtacgttaaaaaaggcccgggaaaaatcgtttatggaaggaagggaatataagcatgtcgctcatgacggtatgccatgggataacagtccatgcttttacaacctggaagaaattgatcgctggattgagcgccaggcatcagcaagaccaagacgtcatcttacttgactaaaagccacactaactaatgagagaagttgaaatgaaatatccgacaggcgtggaaaaccatggagggaaattacgtatctggtttgtttataaaggcgtaagagtcagggaaaacctggggttcctgacacagcaaaaaacaggcgcgttgc

SEQ ID NO: 106 - DNA  (genomic), 44 bp; double-stranded, linear
taaatatggataaggtcacgtcccctggggagtgaccttaccac

SEQ ID NO: 107 - DNA  (genomic), 841 bp; double-stranded, linear
tcctgaatcggactgtctttcactccctctctccactacattcccttgctcatttagcatctgatatggagtcatcagtgaacaaggccccctctttaattgccgctatcgtcctcggactggggattagcgcctgtggttattttgttggcgatggtgttaaacatttaaaaaccaacaaccgttatgtcaatgtgcgcgggctttctgaaaaagaagttcgcgcagatacggcggaattaacaattgcgattaactttaagggtaatgttcccggcgaactgttcccgaaactggaagaagcgcagaaaaaaattgttgccgaactcaatgctcaggggattaacgagaaagagataattctgggccaatggacaagcaagcgaacagattccttttatctgaaagatgatcccacaatgccacgctataacgcagacgggtcagtgacgataaaaacccataatgttgctgctgtcgaaaaagtcgtcgcgaaattaaacgaactgcaagtcgctacggatggcgctatcgctgagagcaaagtcgcctatcgctttaatggtattggcgcactgcgcgctgagatgattgctgccgccaccaaagatgcacgcaacgccgcactacaatttgcaacggactcaggtagccaggtggggtcaattagcgatgcctcacaaggcgtattccagatctttgccagtggcagtgatgaagatgatcctacggcgattaataaaacggtacgcgtagtcacgaccgtaacctatgcgttgcaggattaaccacttttctccggcgggacactaatccctccgtcctgccggacttttctcat

SEQ ID NO: 108 - DNA  (genomic), 1314 bp; double-stranded, linear
aaccgccccgggaatcctggagactaaactccctgagaaagaggtaaacaggatgactaaaaatacacgtttttcccccgaggtccgtcaacgggcagtccgtatggttctggaaagtcagggcgaatatgactcacaatgggcggcaatttgttccattgccccaaagattggctgtacaccagagactctgcgtgtgtgggttcgtcagcatgagcgggataccgggggcggtgatggtggactcaccaccgctgaacgtcagcgtctgaaagagctggaacgtgaaaatcgtgaactgcgccgcagtaacgatatccttcgccaggcttccgcttattttgcgaaggcggagttcgaccgcctctggaaaaaataatgccgctgctggataagctgcgtgagcagtacggggtcggaccggtatgcagtgaactgcatattgccccgtcaacggattaccactgtcagcaacagcgacatcatccggataaacgcagtgcccgtgcgcagcgcgatgactggctgaagagagagatacagcgcgtatacgatgaaaatcatcaggtgtacggtgtgcgnaaagtctggcgccagttgttacgcgaaggtatcagggtggccagangnacagnggcgcgcctcatggcggttatgggacttgccggtgttctccggggtaaaaaggtccgtactaccgtcagccggaaagccgtttccgcaggcgaccgcgtaaaccgtcagttcgtggcagaacgtcctgaccagctgtgggtggctgattttacttacgtcagcacatggcagggcttcgtctatgtggcgttcatcattgatgtgttttccggatgtatcgtggggtggcgagtctcatcgtctatggaancgacattcgtgctggatgcactggagcaggcgttnngggcccgtcggccgtccggcacagtccatcacagtgataaaggttctcagtatgtatcactggcctatacggagcgactaaaggaagcaaaactgctggcatcaacagggagtacaggtgactcgtatgacaacgcgaatggcggagagcatcaatggtctttacaaagcggaggtaataccccgtaagagctggaaaaaccgtgcagaagtggaactggccacactcacgtgggtggactggtataacaatcgacgattgctgggaaggctgggtcatatccctccggcagaagcagaaaaagcttattatgcttccatcagaaacgatgatctggcagcctgagttcacagataaaacactctccaggaaaaccggggcggttcactgtt

SEQ ID NO: 109 - DNA  (genomic), 225 bp; double-stranded, linear
atcaattcgttaaacacgacatacaactcattaccctgcaaataattacaactggcaaaagccagagacgggcttttatgcccaggagatgactcatgatgagcaatgttaagaaaaaagatgtgccgctgataagcatcagcctggtggccattcttttcatcgcagctgcattaagccttttcccacaacaatcggccgacgcggccaacgcaatatacactt

SEQ ID NO: 110 - DNA  (genomic), 102 bp; double-stranded, linear
actgccaatgtcggatgcggcgcgagcgccttttccgacctacggttcgctatctctggtatatgcctgataagacgcgaatagcgtcgcatcaggcacact

SEQ ID NO: 111 - DNA  (genomic), 21119 bp; double-stranded, linear
actatcaaccaccatttataaatcataaccttatgattttattaactttgaaaatggctctatacaacgccatttgaatctattgtcactttttatcgccactttttaccctctattgtcaaaagggttcaattcaacagcagcctctaaatgacctggagcaaaatgcgcataacgcatagtcatttttatatcgctatgccccagtattttttgcaacacaagaatatttccaccccgcatcataaaatgactggcaaacgtgtgacgtagcacatgagttaattgcccatcaggaagctcgatcttcgctctcttaattgcagcgtcaaaagcctcataacatggtgaaaatagcgctcctcgttttttaggaagcatagcttgcaattgaggtgaaatcggtacagtgcggtcttctttcctttagttttaacaaatgtgattcgaccgggcagtacttgagattgctttaatccttctgcttcactccaccgagcaccagtcgcaagcccaatacggacaacaacccccaaatntttattccgtgactcatcacacgcaatcagaaggcgttcaatctcatctacatacagaaacgccagttccttttcttcctcacgaaacttgcgaataccagtcagggggttttcaccagaccactccccaaggcgcttcagttcggcaaaaacagcatgtagatatgactgctcgcgattaacggttgcttcactaagttttttcttccccttgggattccattctcctgatagccttctttcccgataagtagcaaacatatttttgtcaaactgagaagcaaatggatctcccagcctggaacaaatcgcctcaagtttgactttgcgctctgcaccagaggacaaggttttaccgtacatctcaaaccaacgagcaatcaactcagaaagacgaggaccagaaccatcttgaaactcgtctccaactctactattcattaaacggcgctcataagagagcgcctcactttttgtcgcaaactgtttacgaatgcgttttcccgatgccccgtagggataacattcacaaagccatttacctgatggaatcttacgaaccgacattttagttacttatcacataaatcaaatgcagccttagtgacatcccccagactcttttttaaccctggggcggcatcattatctagccaaaatggattattgttatctaacggtaacgcaccaaatgttttaccttttattcgagccaaacctgtaagtgcatataacttattatcgtcaaaattcatcacataaggattaccatcaagacactgtaattgaacctcatcagtattaaatggccataccccattgaaactctcacgttcaatagttttaaaaggcattgcgacggcggaaaaagaaaacatagataaaaaagtaactaatagttgaaccttttttactttcatatcattacctcaatttagctcaagtaagattacaaattaaaaaacgccctagaaatgacaccgcctaccaaaacccttacgcagataaagaatattatttcttttggataaagtcggattaattctgaagcacgaagtcggacttctggtaaggtcgaactctctatgtggcttgatgccgattgttgctctaaccacgacaatgcagactgtaactgagaacgagtaagatcgtttaaacgtcctgtaccgaaattgatatggcaataccgcagaagtttttgtcgaagtccacagtcttcactgttacgtagtaataaacttacaagagccttacaggcatcatgatctttacatcgctcaagcattgcatgcagaaaactctccgctgttttatattgatttactgtcatatcatcaataccagctacaccaatctccgcatgtactttttgccaaataataaacgcttcagtattgctagcttctgcaatagcagcaaccaagctatttagctccttacgctgagccttaagcaaagggcgatcgtcatcatcattattcgaagggattgcgatattgacggtatgagaaccatcatatcgctctatctgaatattcttttcgtgaaaatcacgcccagcaacgcgattgtttgaaccgtttgagttgacggccatgtcacctccctactatcacctacccttagtttcgttatagtcacgaccagcgatacggttattaccaccagaaatatttaactcacgtcctgatggctgagtttccttttcactgatcgcaccttttaaagccccaatcaccgcgtttttcacatctaacgaagctgctcgaaagcgagtaatcaattcctgctcatcatcgttataagtttcaggtgagtgaattcccaacacaacatactgaacatcaaggccaaaacgagacagcgctgccaaatacgcagcatcaggaaagctatctcctttctcatatctaagctgagttagctttttgactccaccaatgtcgctcatggcaacttgactaagtcccaatctttccctttcctcacgcaaccgccgaccaatatcatttttcatacaaaaaccttgacaggtatcttttttgataccaaaatgatttcacgagctattagatgatcacaatataccactatgaaacaagttcttcacgataccagatcacgcattccgcgtaacaccgccacaggtccaagactggcacttcggctgtccctcgaggagcgagccgtcattgatgaaatggcagctaaagaacaacgctcatcctctaacatggcgcgcatgatctcccttcgcggcctagagctaacccagaaagaacaaaacaaatcttcctgatcaggaggctagtgggatgtcaggtataaccatcaatatcaatgtgaatgccccctatgtatccctgcagaaatatgcagagataacaggtatccctcttaatacatgcaaaaagatgttggctgacggtcgaattattatccgccccaaacgcgccaaaatggaaaagcctgaagtaaaccttgtggcgatgttaaaagacgctttggctaacagctaaaacaatgaacagagcaccatcatgaaaaaaaacgctaataatccatactccaaatttcgtaatggcgtagaacgccatgtacaccacgtcgctaccagtgcatcacgtagtaacagtcgctataacctgaacgagacgcatgcaacaccggatggccacgctgtaaaacaaatcggcgaacatgcctggctgattgagaaagctggaatcgtggtccacaaatgcccacgcaatccgtttaccgggaaccgcatttttgcattgaactgcggcgacaatcacttcgggcaggatttcacattatacgaagcacttcgcacggttgatcgtctgcttcgcgggcaaagttttattaaacaggctgatttataacaggtgctttatgaccaaagagcatgcacaaggtgtatttatccgttttattgattttcgcggtgaactgttattacgcgcatcagccattgacggaattgttccatccgaaaaaaacgcagctacttacgtttatctgaacggtacgcgcctgactgtggagcttccgtaccagaccgtacgagaaatcattagcgaagctgaaaaggctcgtcaggttaatggcgatgaaccctatatcgaaattatttgtatggattcagaagctgaaattcagaaagcagattaaagggcgttgcgatgggcaaagaatataaaactctcattaacaaagcacctgaacgattttattttcgcttaagtgcatcaggcgctcatgctgaacgtgcagcccgtgactcattgaccagggcaatccggagtttgtatgacgttgctttttacgctgatgatctggatgcacttaacgaactttccgagctgatctgtgccgcagaatgcggggaacacattgaaccatataagctggggaatatcgcatgagtatatttatctcatggcttgttctgattatttcggtggcctgcgccattgggattatgcgaattattcattcagtaaaaaagattgaacgctttttcactgacaaataacagcttaaacagaacaccagattaaacccgaaaacctgaaaactatccgcattcgcggaggtattcgcacacgtaaataacggagatataaaatgaacgcaaaagaaaaaaatattatcaatacattaaaaatagtgtcagcagagcaagacaagctgtccagggcagcccagaaagataatcaacatatggcagcgctttacgcactgaccatcgcaatagccacccctgaagcagccaaagttattgaggaacagagcaaagaaatcgacactcttaaaacacagtcaacagttgcagccatgaatccgtccagcattggacgctgcatttatattcttggttcagcaatgatgctgcaatacaccattattgccgaactgcacggcaaatacctgataacgccttaccacacaaaagagtcagagcttctgacaaatctccgcctgatagaacgctctcaagctgtattcattgatgacgcgcaacgtgccgtatttaacgcatagggttactggacaaagggggcgcaatggcaattaagcattttcccgtcgttcgctttacctccagagggcgcgaatacgaggtcgacgaacgcctgattaccactatcgacaaacatcgttcggaaaaggatgcacaccacatctacctcactgacggcacttacttctgcgccaccaacgtggcgcgagtaaatcttatccgacaggtacaggagccacgcagatgaccattctggactacatcgctactcatccggggtgtagcggcggagagatcgccgcagcactgaataccccaaccacagccattaatgctgagttacgccgactttggcgcggcggcttagtcatcagaacaaaccgcagcacaggtggtcgcgctcgcaaaacaggaggccaggcttcttaccacgtaaacccgatgccgttcgggtgtagcaatccacttactcacatgtttaaccagctactgaaggaagccagagcatgagcaccatcaaccaccagaagctacgcgaactggcatttgccctgcaacgaatggcaacgcctcaaaaattactggcatttcgcgcaatgctctcgccgtctgctgtgctggcactgctggatcagctggagcacgccagaaccacggctcctgccattcgcctcacgctccatcatgaaatcgctgatttctgcgcaacgctgggggcacctggcgaaccggaaacgccggaagcaatgcagcaagagctgctgcaacgcatcgataacgtttttgatttttttctgaaccagtaagaaaccagaacatgcacacacaaaaaaaccgcttgccatgccgcaatcggtcaggttacatttccgctgcacctcataaaacgggtgccgggattctcaacccgatacagagcaaagcgcataaccgcgctagcggtttttttgtgcgtactgtattgccacgtctttttcgcgtcagaattatggcggggcgtacggggccgacttcggtcgggccggattctttgctctccggtgttgagaaccctgtacgtctcgccagcccgagattctcaactctggatggtgagttatttctatcaccgagcaaagaggccacaccatggcagaccgcaaacagcaccgcgctatcgcggagcgtcgtcacatccagactgaaatcaaccgcagactttcccgcgcatcacgcgtcgcgcaaatcatgcacatcaatatgctgcatgagcgcagccacgcactatcaaacatttattccgcctctgttttcagctatctggcggatgatctgcacgagtttcaacagctcatccagcagcaaaacaaactccattaattcctgttccgggcctttcctgcaccttgcggcgggaggccttcgcacatctgtgacaagangattgccgcaatgattctcgccaacgactttcttgaatacctgctcaacacagaacgtgatcttgccgctcgcgtgcgtgatcgttatgacatgtacctgaaatccctgcctgtaccgcagctcgctgacggaaagattgttattgatggtcgctacatgattgacagccacgagggaaattacaggctttaccgcattgaaggtggcaccccgtccgttattggcatttaccagcgcccatcctctgcaatcgtcgatgtgattgccgacagcatccgcatcacacatcgccatgccgacacagaagacaccgtgctggaaattcagcggctggctacagcctgccgcgacaccctgaatggcatgacgaagtaaatcactatgacggcagagtacatcagggactggcaacaaccgcgccacgcagtggggcgtgaaggaacggggatccccgctcctgaatccgcgctttcctcctggctggatgcctaccgggtagagaacgagcgccgccaggaaatggctgatgcggcgttctccgcaacgccgctgggcaacctgattaataaaagcctggacgcacaggaaaaacaggacaaaaccatcacactggcaggagacgccagaaaacaggcacgcggtgcggtggatgaagccatggcctcgctgcgcctgctgccgtcctatctgcgcgatccgcttattcgccacctctccttcctgcgcaaaaaacaggaagccgatcgtcagaaaggcaaaaagagctggcaggctgaacgctacgcgcgcggaaacctgcgcaaaatattcgaacgtctggagcgcaccgatcaccgctggctgacacagggttatcgctcccttgccggacgcgaacgcctggacgatttgctttacctgccgcagctcaacaaacaccagatacagacgctggccaccatgacggcggcgatgttcagcagcaccttcgaaaaactctgcgatggctttggcgcgaccgatggcgaactgaccatggatgtaacgctgaaggcgtatcagatgctggcccgcatggcgttacacctgcacgccatgcctccacattatgacgcactgacaacagacaaagaccggaggaacgaaccggacacggagctgctgccgggcgcaatccttcgcctgacctgtgcggaatggtggaaacgcaaactgtggctgttacgttgcgagtggagagaagaacaactccgcgccgcctgtctggtttccagaaaaacatcgccctatctgagccaggacgcgttaagcgagtttcgcgcacagcgcgagaaaacacgcgatttcctgaaaagtttcatgctggaaaacgaagacgggttcacgattgatctcgagacagtgtattacgcgggagtaagtaacccggttcaccgtaaggcagaaatgatggccaccatgaaggggctggaacttctggccgaagcccgtggcgacaaagcggtgtttctgactgtcacctgcccgtcaaaataccacgctacaacagagaacggtcatccgaatcccaaatggaacggggccaccatgcgcgactccagcgattacctggttaacacgttttttgcggcggtccgcaagaaactgaaccgcgacggcctgcgctggtatggcatccgcacggtggagcctcaccatgacggcaccgtgcactggcatatgatggtctttgctcatccggaagaaatcgacaccattgtgtcccacacccgcgatattgccattcaggaagatcgtcacgagctgggcgatgatattactccgcgctttaaggcggagtatgtcgacggctcaaaaggcacgccaaccagctacatcgccacctacatcggaaaaaacctggacagccgcgccgtggatggcatcgacccgaaaacaggcaaaccacgcgttgaccacgaaaccggaaaatcaatgaccgagagcgtggaacgcgccattggctgggcgcgccttcaccgggtccgccagttccagttctttggcatcccctcccgtcaggtgtggcgtgaactgcgtcgccttgccagccagatggcacgcaacccggaaggcccgcaacggctgaaggatgacgcaatggatgcggttcttgctgccgctgatgccggatgttttaccacctacattgagaaacagggaggcgtacttgttccacgcaaggactacctgattcgcaccgcctacgacctcgcagatgagctgaacgattacggcgaacagagcgtacagatttacgggatctggtcaccactcatcggggaatcctcccgtgtgtgcacgcacccggataactggaagctggtaagacgtaaaccgggagtagaagacagcgcccgcgaaaatggttttgaccttcagggcggccctgccgccccttggactcgtggcaataactgtccccgtgtacaggaaacggacaacaacgggacagaacagccggaagaacggccagcaccgtggccgcagcttcctgacggcgttgacgtgaacgaatggatgcgctcactgaaacggcacgaacgccgggcgctgatgcgttcgtttcgtgacaaacaggcaaaaaacagcagtgatgaaatgcagagctggacacagagccgcaaacagcagcggcctttgcctgataaccacgaattactcgctaaagaatggcgggagtctgctgaatctctcggcctgcatatcggtgaacaacagatgcagcacctgttacggggcggcagtctgtacgttgacggcagcatcattgcaccgcagggatttgaaattgtacgcaaaccggatacccgcccggacagccgaatcacgcagctctggcagcgcctgagccgtaatcatggcgtaagcagcacggagatccgccataacccggtcgccagctatctggcacagctgggggcatcagaccctgaagccgccgcacgcctggcatccacacttcagcaggaccagaacaccatgaaaacacccgttaccgtgctttctgacatgctgcgcgccatccgcgacgcagagcacgcacagagaatcagtgaaaccactgaacgcgccagccgcaaagcagacctgctgcggggtggcctgaccagtggaaacaaaaaacagacagaaacgggactcacaaatcccgtaaatgagcaaaaaacgcgccgcgatatatgaagcgcgcacaaaacaggcaaaagcgggatttaaaaatcctgtaaccgattaattaatcaacataaggaaaagcgacatgaaaatttgtatcgacgacggctccaccaacatcaagctggcatggactgagaacggcgaacgccgcaacgccatcagcccgaacagcttcaagtcggaatggtctgcgccattcggtggcacgcagcccgcgaactacatgcttgatggcgtgcgctatggttttgatccggtcagcgatcgctttgtccagacgaccgacacgcaataccagtacagcgatgtgaatgtaattgccattcatcacgcgctggtcaaatcaggcatcacaccacaggaagtggatgtggttgtcaccctgccactgagcgagtatttcgatacaaacgcacagccggacatggccaacatcaaccgcaaaaaagcgaacgtcatgcgcccggtggagtaccagaacggcgaagcattcactatccgtaacgtacgggttatgcctgaatccattcctgctggctttaaggcaccggctgacatgagtccgtttgaatccctgctgattgtggatttgggcggaaccacgctggatgtggcaaaggttcaggggcaactggcaggtatcagccaggtgttttgcgatccacacgtaggcgtttctctgatggccgatgccgtactgtcggtgatggccactaacggtatgcgcaccagtcaccacatcgccaataccattatcgaacatcgccatgatgaagcctggctgcgccagcacatccacaatgacgcgcattacgccagcctgatggcggttattcgtgaaaaggaagaaacactgaaacaacgcgtgatccgcgcgctggcggttttttcgggttacgggcgggtgatggttgtcggtggcggggcggagattgtggcaaccgctatccgcgaagcctgcggagttaatgcgactttcatcgcggacggggtgccacagtttgctctggttaatgggttgtacgcaatgaacaaggagtaaaccaatgacgacaccaaccagacggataagtttctatctgaagcccgccgccgtcaagagtgaacaggaggcgtgcaattacctcgatagcctgccagcctccgaacgcagccgcgcgcaacgcgcggcctttctggctgggctagcactcataaagcgcaacccagcatttgcctactggatggccgaatggccagaggacaacctccccttcaataccgttagcatcaaggaaacataccaggctaatcagcctagcggagttgaatgcaatttttataaaataaaaaagaatattcagaccttattcccagaataatctgataattgtatgtgaactaataaaatacattgtcatacgagtcacctgtactccctgttgatgccagcagttttgcttcttttagtcgctccgtataggccagtgatacatactgagaacctttatcactgtgatggactgtgccggacggccgacgggcccacaacgcctgctccagtgcatccagcacgaatgtcgtttccatagacgatgagactcgccaccccacgatacatccggaaaacacatcaatgatgaacgccacatagacgaagccctgccatgtgctgacgtaagtaaaatcagccacccacagctggtcaggacgttctgccacgaactgacggtttacgcggtcgcctgcggaaacggctttccggctgacggtagtacggacctttttaccccggagaacaccggcaagtcccataaccgccatgaggcgcgccactgtacatctggccaccctgataccttcgcgtaacaactggcgccagactttacgcacaccgtacacctgatgattttcatcgtatacgcgctgtatctctctcttcagccagtcatcgcgctgcgcacgggcactgcgtttatccggatgatgtcgctgttgctgacagtggtaatacgttgacggggcaatatgcagttcactgcataccggtccgaccccgtactgctcacgcagcttatccagcagcggcattattttttccagaggcggtcgaactccgccttcgcaaaataagcggaagcctggcgaaggatatcgttactgcggcgcagttcacgattttcacgttccagctctttcagacgctgacgttcagcggtggtgagtccaccatcaccgcccccggtatcccgctcatgctgacgaacccacacacgcagagtctctggtgtacagccaatctttggggcaatggaacaaattgccgcccattgtgagtcatattcgccctgactttccagaaccatacggactgcccgttgacggacctcgggggaaaaacgtgtatttttagtcatcctgtttacctctttctcagggagtttagtctccaggattcccggggcggttcaatctgctggccggaactaatgaatttattggtgaaggtgacgcatacattccgcctcatacaggtctgccagcaaacagtaccgatattgcaccgccagatattccggctggcttcgtggctgttttcaacagtaatgaggcatcgtggcatctcgttgaagatcatcggggtaaaacggtttatgacgtggcttccggcgacgcgttatttatttctgaactcggtccgttaccggaaaatgttacctggttgtcgccggatggagagtgtcagaagtggaacggcacatcctgggcgaaagatgcagaagcagaaaaactgtttcgggtacgggaggcagaagaaacaaaaaacagcctgatgcaggtagccagtgagcatattgcgccacttcaggatgccgtagatttggatattgcgacggaggaagaggcatcgttactggctgcatggaagacatatcgggtattgttgaatcgtgttgatacaacagtagcagcggatgttgagtggccagtcgccccacaataaaaagaaaaagccatcgacagaaatatcgatggctttatgtactctatttatacaatacaacaccactctttttagttatatatgtgcagtttgatggtatatctttatttataaaagacattgcacctatttttacattatccccaattttacgtgataatccaatgatgcaacaattagctccgatatcaacgttactaccaatttttactcttgaactaggcatatcaccatctatctgtccaatggtagtattctgtcgtaataccagattttcacccgcatcaacagcaaaatgaacaacaattccagcatgatggggaattgtcaacccttttccaatatttgcgcccaatcctatttcacaaccaaacttgttaattattttactgtttaactttttggctgctttcttatgtaatttattaccattaatatacatttcgttagccaaccgccaccagaaaaggaaattccggttacgctgctttttctctcttaaaagcctccagatatccatacgtttccgccgaattacttcatgtttccagaagttttttaaattagtagagtttccaaataaaacaaagtgaattgccattaagtaagatagcacgataatctccttaattattatttcagaccacacatgttataaggttaagagattataaaatcctgttatttgttattcaaaaacaattttctgagaaggacatacaacagcaagtcgccagtcaccttcatcaggaaattggcgacatacgttaaatcagagcagccccttaactgagctggccgcgctattaagggatgatgtcaccttatctttgaagccggacagcatatcgctgaacgatgaggattgcaggcgctcccgcaaatcctcatcacagcgttcaagagtcagtgaaaattctatctttttcgccttaccgtagcgatcaaactcggagcgggtcgtattcgttccggtcaggacatacatgccgtaaatctgcccgacgccatcaatcaaaggccaaggacgtcctgtatatgcctgcgtggtcaacaacgacagcgacacttcgccaccagtaatctcaggataaagaacaccagaaagaacgatgcgatcatcacctgcaccgatatactgccagcttgctgaacggttaacgcgttcatttttcacatgtcgccagcttttgttttgctgtaactgctgatgcggcaacgtgcgcagctcaaaaacaaacatgccgtagatcatcatcatggccatgactcctcaatctttatcgtaaaaactgccacgcctggcacgggcgcgccgttccatttctgccctgaccatttcgccgaccagtttcgccagttcgcggggattctgcgtaacaacgttatgcagatgaacatgaatttcaccgccaaatccggaggcaacaggctcccggttacgggaagttgcaggaactgatgccactggcgatcgtatggcctccaccaccgggcgggagctggccgcaacaacagggaccagcgccggaggcagcggagccgggaccacgggtgtgatattaattgcgggggcaggcttactgacctgcgcaatcttccgctcctgccactccccacgaacagcaagtgcgcggggcaggttcttaaagacaatatcgccggggccaatgcgtttttttgtctcatcaaccagcttacctgtgttatcagcaattttgctgagtctgcgtagcgtgccggtattgctgtctgtgagaggtttgttgtctttgggtttatcatctccggtgccattgctatttcccgcagacttcggcggattgattttcgcaatgtctccctgaaacagagcaaccttgtcctgaagaatggccgcacgttgtgcgtcttcgattttcttgcgcgccctttccgcttcatccggaagcacaccgagtttttcaagtatccacgccagcgtatccagcaacatttttgcaggcgtcagaacaagctgtaacgcaccaccaagaacgttaccgaatacctcgccagcactggtacatttatccagcgtttccttgctggactccatcggtgacagcagcgatttaaaccagttaaacacctggctgaaccgcttccgattacgtcaaaaacagggccaaaccgttcaaaggtgtcgcgcaacggggtcagcctttccataatcccgctgaacaccccggcaaagaaagccctgataggatcccagtatttccagataagaacggcagctccggcaagcgcagccacgataagaccaaccggactgaacaacgccccgataacgcctcccagtaaagaaacggaacccgtcaccattccccatagcgcaggtaacaccctgacgacattcattgaccgggtaagaatgtcaaaaccaagacgcagggtggccagcttcccgtaaagcaccccaataaccagcgacaacgagccaatcgttgcagtcattgccagcaacgcaccgcctgctatcagtagctggcgcgtcagtaccggatgggcctgcgccagcgaggtgattttttcaagcacccgcgtgagccactgcgtgacagaacgcagcggaccgtcaaccagatcactgatgcgaatacgaagaccttcccatgcgctgtcgagatttttcaggtccccatcaagattatcagccattacttttgcgacgcgatcggcctctccccttgccccctgcaattctctggtcagtttttgcagctctcctgaaccagccgccgcaacaagcgtctgcaaaccaacgaacgcctcttctccggcgatgtccttgaagaaggagacctggtccacctgtccgtatttttgtgtcgccttatagagatcaagcagcacatcctccatcgggcgcattttgcctctggcgtcagcaactgacacccccagctctttcagtgcatcagccgcagcttttggcggtgatgcaaggcgggacagacttgcgcgcatggccgtgccagcatcgcttccgcgaagaccattattggcaagcatcccggccatggccgccgcttcttcaagactgataccaagttttgcggcaaccggaccggtatacttcatggtttcgcccagcgcgcgtaaatcagtattggtccgggtaaatgctgctgtcagcgtatcgcccacccggtccatttgatcggctgtcaggttgaactgtgtgaggatattggagcctatatcagccgtctcgccgagttcgacgccacctgccagcgccatattaagaacaccgggcaatgcggcctgaatggcctgcggagtaaaaccagccattgccagaaagctctgcccactggcggcatcactcgcagtaaactgtgtttcagcaagttttaacgcctgctcacgcagcgccttaaactgcgggctgtttttgtcgattcgcgtcagtgcctgaacgcgggacatctctttgccgaacccgatcgcaggctgcaaaaaacgcccggcagcatagccgcccgccgctgccgcaccaattgccagcgcaccacctgttttcagttttcccgcggtttcctgcgcgtgcgaataccgctcacgcgcctgcgttacacgcgcaagcgcctgccgttcgcgttcaagctggttgttgtattgttcggtgcgtctgatggcctgctgaatggtgttatcgctgcctgtcagggaaatgccgtggcgtttcagctctccgccaagttccctcattttctgaatttcccgtgtgcgcgattcattcaggcgttcaagccgggtgcttaactgctgcatcagcttttgttgtttttcgctgagcactgtacccgtgcgttgtaactgattaagggcgttaagctggcgtcgtgctttcacgatgccagcatccgctttactgacagcgtcgcgggcgcgctcaaatgatcgcgcctgacgctcgagatttttgatcgccccctgcgttcgctggatggagtcaccaaactgccccatcaggcggcgtgcgttttcggcaggtcgggtcagcctgtcaacggcgctgaaagcgacccggatatcaagagtcttcattgtctgcattcccgctgcgaagtgccgcccgctcacgccagctaaccacttcgccgggcgtcatcatgaagatttcggcgggcgaccagttaaaaataacggcaatatctgccacaaagtcttctatgtgctcaaagcacacaaccgtgatcaggcttccgtcgcctgttcgttcttcccgccagagtccgcaccgctcaaaaaatttacggcaaccacacataactgaataaagtcacgggatgccatttttttgatcgtcacttcatccagtcgcggtgatgtcacgcgtgacagcagcgtaaacatggattccgctttcagattcagcacatcagacagcgacaaatctcgcagagatccagcctgctcaatagccccggtgatctccacatacgtgattttttcgccgcctcgctcaattggttgggtaagttttacaccacgctcactggtttctttcacagtgtcagtaactaccgtgttttcggtatcgatgtttttcgtctctttcatcaggaaactcctttcagtcagaggcgacgcactgcgccgcctgcatattacttatcagccaagcccaagcgcggaacggatgcgatcgggcacaatgtccttgccgtccttccggtaaatgaagttcagcaggtcaatctcccacaacgggcgatcgttaacactcagcttgtagtaggtgtttttaatggcgtaagtgtgtgatgtggcttcgccctgtttggcttcccccatatcaatttccgtcacacgtccgcgcatttcgacttcatacaggtcgctttcatcatcggtgtagtattcccccgcaaaacgcagtagcgtgccgtcaatcgtgccgccatacttcaggaacagctcacgaactgcgccccccatgacaaagctcgcatcaagcgcggagtcgtccaggccgaggtcaatacttaccgcacccatcatgccaccaccccggtagctgtcggttttgcgcgtcagtttaggcagggtgacggacgtcaccttacccacttcgttttcaccatccacaaacagcgtaaaaaagcgaagatgttttggtacagccatcaggcacctcccagcaccgcaaatgcgggaccaaagaattcatcagtaaacgactggtaaagctccatgtcttccagcggaggaacgggcgtatatttgtagcgaatacgcacacgcccctgacgtaaattcgtggtgctgttatcctcgatgtcataccagcactccgcgccaatcagtttcccggcagtaaccagtgaatccagttttgccctgatggcactgataacatccttcacgttcgcaggtgtcagtggactgtcgatggtttcaaactgcgcttccgcaattgaatcagccagcacctgtgcggttcgggtatacacctcaaagatgtaggcgttcgtttccggtgtgcggttgccccagaagcggaacccgttgcgacgaataatggtcgtgatttctttgttgttgaggctgttggcatcactgtcttcggcctgcaacgaccagaacacatgcctcgacatcccaagcacatttttaaccggaacgttggacagcgatttgtgccagccctgctcatggtcaatgtacgcacgaaggccgcacgcataagcaggcgcggggaacgtttcgtttttgccacttttcaggttgtaggcgatgaagtcaggccataagagcatcacctcacgttcgttgaatttctggcggtaggtaatcgcctcagccatcgtgttacaaccatgacatgtggcatacacaaacgcgcgcagtttacccgcaatcacgcacagggattttgttaccgcctccgtgtccagctccggcgcggccagaatacgcggacggtatccgatgctttcatcctgctctgcaacaagcagcgcatacatccccgtatagctgccgtcagattcagaaccaccgataaccagttgatcctgcgtcttaccgccttcttctttgtgttcagccacgcgaacgacgatcacttttgtgctcacctggtctgcgatagccttaagcgcacgataaagcgtccccgtagtcccgcattttcccagcacgtcattgacgcgggtcagcagtgtgggcttgttcagcgggaacagctccgcgtccgcatcatctgccgttgccacgataccgataacactggaatcaacatcattaatcgctgttaccaggtcggtactttccgtaacacgggcaccatgaaaacgagtttcactcatagcttcagccccttgtatccgttaaatgattcggcaacaatcatcacccaccacgcgcgtaatctcacccctgcgccgttctcccgccacggcgacaacaaaaagcagtaaccccctccgcacgcacatgcgaccatgccgcacagggagggaacagatgaccgacaccaccatgcaattgctcagtcagggcacagaccacgtgaaagtgccggattttgatattctcgcggagggtaaaacgctgtcaggcgtggcagaacgcctgatgagcctgtcactgaccgacaaccggggatttgaggcggaccagctcaccatcacgctggatgatgcagatggtcagttgcagctaccgccacggggcgcgcgcctgacggttctcattggctggaaaggagaaccgctgacagaaaaaggcacttgtagattcaatctgtcaatgcaacacccctttcaattatctctttcggtgttttgaacttcagtgtctttctcggtctgttgtttagctgagcagcaaccagatcttcatgttgagtatattgggcaagacatgtctttttaggaaagtactgccgaattagcccatttgtgttctcatttgttccccgctgccaaggactctgaggatcgcagaagtaaactttaacgccggtgctgacagtaaattctagatgtctggccagttccattcctctgtcccatgtcagtgattttctgagttctgacggtaaactcaggaatttgtcggtaagagcctgatttactgagacagaatctttgcccctgagtctgaggatgatcgtataacgygattttcggtctacaagtgtggctatatgagagttttttgtacctgagactaaatcgccctcccaatgccctagagagcgtctgttatcgatatttcgggaacgttcgtgaattggtgttccgttcactatgttaatcgtacctctttcgcctttgcgggtatgacgcctgccatggcgaaggctatgcgaccgtcgcagatgctgtatattcaggtggtgtagcgcttcacggctacgaaagtacagcgttttataaattgtctcaggtgatattcgcagcgttttttgacgtggttttgttcgccttaaccatcctgatatttgctctggagaccatttcatctccagcttttccagaacaagctttcgcaatggtaaattttgatccagtaagcacggttttggccttttcgccattctgttggctcggttattagcatcaacagctttgtaatagcgtctgccccgattacgctgaacttcacgtgagatcgtcgaaggactgcgattcagcgcagtagctatcgcacgaatgctcattttggctgacaaaccagctcgtatctcctcgcgctcagacagtgtcaggtgagctacagcccgcttacgctcatggggttttatgccgccagtatcccttaacatagtgaagatcgttccgggttttgaacccaggatattcgctatttcactgaagcctgttccgttcttccatagttccaaacttccgcaaccccatgttttcacataactgttgcgttgaccaattgaatctacacttacattgttgatgaaatcgctcacgaaggaccaccggacaggctttcagccagaagcgcagattttcgggatgtgaaccgttaacggcacataatgctcgcacaacaaacctgttaaaagagattactcagcattctcctgcttccattgccggatcatttcatcggtaacatcaccctcataacataccacgtcataccctccattacggctatatgcactgcgtccaccacatctactaccattccttgcatgattataaggacacgcacaattgcctggataagattcaatggattctttaattatttcttttttgatctgagcatcagactttcctgttgctgcatatccactaaaagatactaaacaaaggcagattgccattaataaaccacatcgcataccgatacactcaattactaaccaatcatagcccacatcataaaatcgagatgaggagcacaatacctttaacaagaaggtgtcataacgataatatgtngtgcaattcatcaaaaaaaagatntatatcgaagagaaagaactcttatcagtgcttcagacatcggcattcgaggcagcagaaaaacagtaaatctgacgaattagccttttcccaagatgttgtcagattaaaaagatagattagcgcaggtacctgttggtggattgcaggaggaaaaataaagtcgagtggaaaaatcccagaaaaanttttgtttaacagaggtcntggttcactatgcgaaatacggaggagctgcagaagaattctgcttcatccttagagtttaaacagcacgtgcactaccatngtttctgcatatcgccacaccatcgccactctaccgccattgcacaaaatacaaatacgaaaaaaccacccgaaggtggtttcacgacactgcttattgctttgattttattcttagctttcccatggtacccggagcgggacttgaacccgcacagcgcgaacgccgagggattttaaat

SEQ ID NO: 112 - DNA  (genomic), 931 bp; double-stranded, linear
cagaaccagcactggtagtctcagtagtgattttacccgcggagttcacatttacagcagtaccaattgctggagcataatctttattggtatcagtcgctgaagcatacccggcaacagtcacagagccgttatccttgttaacgctgtaagagactgtatagtcggcaacgttagtgataccacctttatcatccacataagacttcgcagcatcactggattcacccgcggtaaacccaatagttttgctcagtacaccggaattaaaggtaattgaagatgtcgcggcagccgctttggtttcgctcaatactacatctttactcactgtagcctgataagtaatcccaccagggattaacggagctactggagtggttgtcgcaggagttgcttttgcgatggtatattctgtgccattgaatgtcagagaggcaccgtcactaccttcgctcgctgctttgagcagcgctttcatatcagctttagctgcgctaccagcgttgttagtcgtcaagttgcctgcatcgtctacgtatgcctggcttccaccgatggtgatattacctgctgaatccgtttcgaaagaaacagtaccatcttttgtggtgtaagaaccattaacagatttacccacatcagcatgaagggtggcagctaacgcatcacgttttgaagctgaatcagcagcctgcgccgcggcgtctacacccgtaccagcagtagatttagtggtagtaaaatcaccagatttagcgttgtaagtataatctacgccgccaactgtgactttatcgccattccctaatttatcgaatgcagcatcggtagttaacaaggtattttcggttttcagatcataaagacctgtcgtggtgtttaacttcgcgccagcagaagttaaatcacttaccgttgcagctttgtt

SEQ ID NO: 113 - DNA  (genomic), 1958 bp; double-stranded, linear
ggcgaactgaaatcaatgcggaccgcgccaaattatttacgtcggggtgtcgccagtctgattttacgccacattttgcaggtcgcccatgacagatgccttcatcgcctgagtttagaaacgggtacacaggctggatttacggcctgccatcaactttatttgaagcatggtttcgttgattgcgaaccgtttgccgattatcaacttgatccacacagtcgatttttgtcattgacgctatgcgaagataatgagttgctttgagccagacgcagcacattcttgcattcgacgtgctgcgtctttatttatcaccaacaggaaacgccttgtccatagacgccccttccacatgcgtcacaagaaacctctattccagtgacacaattacgcctaattaattacatataatatttaattatgaattcctcaccatctattacatgctttttaaccatatcggaatatttatcataatcggcgggattcataacaatatattttcgctgcgatatttcatagcgaatccctgtaagggtccatggcattaaaaatgcctctttaataggattacatttcatacaaagtaattttaaattgccaggtatcgcaggaataacctcaatcttattatattcaatatacgcttctttcaaatttttggggaaccatctaatttctttaatattattctcactacaatcaaaaaccttagcggtgtctggtagtgctggtatttccgatagcttattgtgacaaataaaaattttcttagcctttggcggaaatgagtcaatatacgatatcaggttattatttacggagatcagggtaattccatcaggtacttgtggaaattctgtaaggttattgaaatcgagttctaattctttgcacgattcgggcacctgtattgaatcaagttcattataaacaaggctaagcatttcaatccactcaggaagaggcggcacagaacccaaagaaaggnttgataagttaagttcattactgtgaagcttaacacatttaaacattctcaccaatgctctatccacattttctttcaagtcattcgatgcgccttctttgactgaactagcccagtcactgaaacctttgcaaagcctggcatctgtaattttggttaacttgtccagcaactctgcaatattggtcgatataaactctaatttatgccgaatgggtaaagtcccctccccctgacttttttctatcgtgatagatcccgtcttatcataagccccataattttcaaacaatagagtataattaccccacctgaaacattgctctctcaataacttaaattcagacagcatattcagtaagttgctgtcttcactaactggtgtaaacttatcatttccaagacaactgactaactcacttgataattcatttatgattgcatcatcagatactaactcgtgttgttttatcgtagactcagtattcgatgtgattttatttaattgaaccgactgagtttttaacgacagatcatttaatggaaacatttacactcctgtttaataaattatattgcccagggcgcattctaaaacacaataaaattgccactatcaaaaatcgctcatttttataacgcagtatattaataaaaataagaacgaagattaagttatccagaggttactgttgcgtctgtggtcgtaacaacatccgacgtggtgatgtgtcaaatgagacattctgatgatcagagggtttatcgcgtatacggatcgtgggtggcagaaaactttcagaatcaggtttccattttaaaccagaaattgagtgagtttgccccatccataaccccacgcggtgagatcggatgtcattaaacaagccaggtcaacaggtcagtatgggaaggcgaacaactcgcaggaatgggtgcgctaaagttgctggatgataaacat

SEQ ID NO: 114 - DNA  (genomic), 62 bp; double-stranded, linear
agaactctgccgtctggcagcaccaggagtggtgtaatgaccacgcgcctgactcgctggct

SEQ ID NO: 115 - DNA  (genomic), 38 bp; double-stranded, linear
taaatagtgataacttcgacagccagggtaatcatcat

SEQ ID NO: 116 - DNA  (genomic), 45175 bp; double-stranded, linear
atgctatgggttaataaaatcaatatattatgtgttttatttggaataaatattctatatttaggattgaaaaatcagatggttagcatcaaacaacctcagaatattccaagcaaacaggttaaaaataaaactgcacccgaacaattgataacgacagaaaacgccttttccgagccaccaaaattacttcgcatcctatttattgctcacgttaacgccttgtataactcgagctctccacggtatttaacctctcttctgtttaactataattccaataaatctcgtcactgagctcaatcacttcgaaagtcaagcacaatatgaatttcacataagctatcaatgaaaatcggaggtcataccattaatcaacaataaaccaagtctttctcatataatcacttgacaaacactcatgataattgtaataaaatatataaggctataatacaatactgtcaatcaatatttcatttatatgagaaaaaggcatttataatgtcaattataaaaaactgcttatcattaattaacaatgcattaaatatacaaaaaacatcatattctctgaccaaaatggagcaggcagggaagttgttaaatagaaaaataactccagaaaatactcctccaatgttgttatcatacagaaatgcagatttaacgcaagaaaaaaacattacagaaagagttttatccatatttaaaataaaacgagattttgttgctgtaagaatccaaaacaatcagtttactgatttgaaaaacaaaaaaattcaaggccatcaaaacacagttgccagtgtcatggattggtataatccccaaaaaaatgctttgggtataactatgggtacaccaagaaaatcggccgatatagcaaaagaagagcacagaaatgcactaaatttcatgataatggaaaaaaacacatttcatgaaaaaatcttaaacagcaatgacaatttgcaaaaatcatacagcaaaacagaagacagtanttgggtcgcagcttctgtcggctctcttctagataaaggagcaaaagtatatcccgatacatcatgctctctgagactgggagaaccattcatctttacgctgccagaatcagttagagtcgatgttgacatatatcctctcaaaaaataatcttaaaggtattgacatataagaaataattaagtgtattcacattagactagtcgcttaagagtagatttttggcattttgggaagatcagcgggacataagagacatacaacacaggaggaatggctgttttttaatagtgctttgaattccgcatgaaacctttcttagcagtcgaaaagcaaaacatacgttttctttttaacaataattgatgagtattgcatcgagtgtcatttatacatcgccgcatttatttgccactataaaaaggctgattacatatctatcggagaactaaaattacttataaggtaatctgcatgattaacaatgtttcttcactttttccaaccgtcaaccgcaatattacagctgtatataaaaaaagcagcttctctgtatcaccacagaaaatcacattaaatcctgtaaaaatcagctcacctttttcaccaagcagtagctccatcagcgcaacaactctctttcgagccccaaacgcccattcggcatcatttcatcgacagtctactgctgaaagttcgttacatcaacaacttcctaatgtgaggcagcgcctgatacaacatcttgcagagcatggcattcaaccagcccggagtatggctgaacatattcctccggcacctaagtggcctgcgccaccaccgccagtacaaaatgaacaatcaagacctctgcctgatgtggctcagcgtctgatgcagcatcttgcagagcatggcattcaaccagcccggaatatggctgaacatattcctccggcacctaactggcctgcgccaacgccgccagtacaaaatgaacaatcaagacctttgcctgatgtggctcagcgtctgatgcagcatcttgcagagcatggcattcaaccagcccggaatatggctgaacatattcctccggcacctaantggcntgcgccaacgccgccagtacaaaatgaacaatcaagacctttgcctgatgtggctcagcgtctgatgcagcatcttgcagagcatggcattgaacctgcccggagtatggctgaacatattcctccggcacctaactggcctgcgccaccaccgccagtacaaaatgaacaatcaagacctctgcctgatgtggctcagcgtctggtgcagcatcttgcagagcatggcattcaaccagcccggaatatggctgaacatattcctccggcacctaactggcctgcgccaacaccgccagtacaaaatgaacaatcaagacctttgcntgatgtggctnagcgtctgatgcagcatcttgcagagcatggcattcaaccagcccggaatatggctgaacatattcctccggcacctaactggcntgcgccaacgccgccagtacaaaatgaacaatcaagacctttgcctgatgtggctcagcgtctgatgcagcatcttgcagagcatggcattaatacatctaagcgctcgtgattataatataattacctatattagctctgacctgacagttaccggttatttatacaggtatctgtcagattacatctaaccaacaaaaaaccggagccggactccggttttgtgaagctgtcgggttacttcatcccgccaatattttcccacgtcccgtcagcacgcaggatttgcagcggtcttaccacacactgtatctgctttttatccgcatccagtatcaccacctgcgtgattaccctgtcctgctccggnataatnccattctcatctgactccaggatgtctgccggccccagtcgcagttgtnctgtaagtaactncccgtgttcacngtcatcatgctttccgcaaccncacagacgctgcataantttttttantatgttcatgtcattctcctgttctgcctgtatcactgcccacttcatcaagccccttaacatcctgccacggcccgtcaccaaacctgacctgcaaatgctgaaaaaaaccctgaacccgtgtggtatctttgggggcaagaaaggtcagtccggtgatgagcgcaccatctgtacccgggaaccagccatggctgtttgtctcaataatgctcgccggccccagacgaaaacggatttgtgtctcccccgggtcgcccttcggtccctgaggtccggttgcccccaccgggccagccgcacctgtttctcctttcggtccctgtgggcctgccgggcctgctgccccggtgtctccctttggaccctgtggacctgcatttcccgtcagaccggtctctccccgctctcccctgtcacctttcggcccctgcgggcctgccggaccagcatcacctgccggtccccgttcgccggttgccccgacagggccggtgtcaccgcgctctcccttatcacccttcggcccctgaggacccgcgggacccggttccccctttggcccgggaggccccaccaccgtggggattcggtttacggcctcttccgccgctatcctgctttgttccgctgactgtgcgctttctgctgactcccgggctttttctgttgcggtcgttgcatccctggctgcattaccggctgcactttctgccgtcttttttgacaactcagcatctgctgcactttgtgatgactcactggctttttgagcggccgcagaggccgaggacgaggacgcctcctctgactgctttgcagcggctgcactttctgccgcctgccgggctgactccgatgcatcccctgctgaagtgtcagcatttgccgcgctctcttctgcctgactggctgatatgccggcattcctcgcggacgtctccgcctctccggcattcttcttcgcctcctcagcgtgacgcgccgcttcttccaccatcagttcaaaacgacgcagtgcctccggccggacgtcatcctccgacatggcaccgagaaaatcattcagcgtccccggttgagaatcttcatacacggtgatggtcccggcatgtgacggcgggaacccttccaccaacagaataacgctgtactgaccgtactcaacgtccatgctgtaacgaccggcttcatccggattttcagaggccaccgtgttcaccaccaccgtggcgctgttacgtctggctttcagttgaatggtgcagttctctaccggttttcctgtgccgtctttcagtacacctgaaatctttactgccatattcaccccacaaaaaagcccgcctgaaccggcgggctgtcataacactgtgttacctggctaatcagaacttataaccgacacccacgatgaaaccgtcagtgcgccagtcgccactgccggagccttcataagcaatatcaatggccacggattcggtcgggttaaactgcacgccagccccccacgccagagacgtgttgctgtggcgaccgtcatcacttccggtcagcacatcgtgcgttttccccttgttgtcagttacgcgaagataatccccggagaaagtcgacacacggctgtaagccacacccgccatcgcatacgcgctgaaccattcattcacgcgcacagacggccccgccattacgctgaaccagcggttacgcacggaatcttcatgccagcgggtatcgctgtaacgggtaagctggcgattcttgtctcctgcatagctgaatgacgtcaccagccccagcgtgtccgtaaattcataacggtatttcacgttaatcccgttaagattatcgctaccgggagcgctcgtccgggcatgaagataccccgcgctcagcgtggcctgctgctcagacgcccatgcaggcgcgccggatacggccagacagatggctgcggacaaaatggcggcataaagtttacgcataattacctctcgcttttctgcaataaaaaaggcgccatttctggcgcccgtatatgggttataaaattcagctgatactgatacctgctgtggattttttcatcaccacaaccagcagatcgctgatactggttgttggtgtccagttattcgctcctgatgaagatacggtgaatgtcagtgtcagcgtcccctgtccggcaggcatatctataactgaggaaaatacgccctgagcatccgtcgtggactgattaaaaatctcctgaccattgcgggtcactcttaaccggcaggttgaataccagtatgactgttggttattactgttgaaattctcatgcttaccaccgcggaataacactggcggtatcatgacctgccggtcaaacttctgatcatcactgattcttaccgtgatggtgccactggcataagtgctcgtgcgggggaaagacttgctgaccgttttgacaatatcgccttcaatctggttggctgacagtttccccttaatctgacagttctcattaatcgtgacgttgttgagcgtccctgagttcgcattcacactgccactgatatccgcatttttcgccgtcagtcgcccgtccggcgtcagggaaaacgtcgggggattgccggacgaggtgatactcaccgcaaacagtcgcttcaggaacacgtcgttcatgaacagctgattcccctgcgccacaaataacggcgtgctgttgccgctctccggatttatcatcgcgatacggtcagccagcagcagtatgttgctcagtggctggccatcagtatcctcaatccctgcaccaatcccggccacatagggaatgccgtctttcgttttttgaaccttcagcatgtacagcgcagccaggtcatcatttgtgtccttctgcacgcgctgtatctgctgtatagtggcgctctggttctccagcgttttactgaccgtctgtgtgatttcattgcgggtttccgtgatggtggtcttcatctccgccatctcatccgcaagctggctgttgtctatcagctcccatagcccctgagccagatgcagttttcctattttttcccggaaaaattccagatacccttcaccatcattgctgggctgcccgctgacttccacaaacgcagatttccccaccaggttgacgctgcgcacgtaaaaccagaaatccgtccccggcttaatccggcttccctggacagtccactgactgccgctccccagataacgggcagatttttccacctgtgccgtgttcgtgatgcgtttttccgaaaaccagaactcaaactgcaccgtcgggtcatacaccgccagcaccggtaccgccgttatctgaaaataccccggcgtcagttcaatggtggcgggttttgctggcgcgttaatccggaaggtggtgatggccggttccccctgctggccataactgttaattgccctgactgtcagggtgtattccccgagcggcagaccactgaaacgatgctctgtatccgcagtgatggcggtggtcaccagacggctgtcctgaccgcttccactggtcaggcgcagactgaagcgcacgcccttcaccacccgcggcgtgtcccatttcgcctgcgccagatactggctgtcagctgcactcacctccaccgtcaggtgctgcactgccggagggatgacgctgttcagggtgccgctctggtcgccgtcaaagtgcgccccgttatccacgatggcttctttttccggtacgtgctgcactgccgtgatggcaaaggtgccgtccgtgttttcccggatggagacacagcggaacaggcgacgacgcagtgacggcagggagagcccccacacaccgtatgtctccacgccatccggcagggtgctgacctgtatccggtccggcgcggggtgtgcagtgatggccacgctcaccggcttaccgctgccgttaatcaggttcaccgtggcggcaccggtctccggcagggtcacctcacggtccagtgtcagggtgcggctggcggcatcgatggacaggatacgtccgccggtcatggtcccggcatagtcgttatcacagatttcaataatgtcaccgggtgtgtgacgcagcccctgtgacccgagcgtgaaatccaccgtctgcgtttccagcagtccggtctttatcacccacagcccggcacggtgggcctgaccgcgactggtacagccgaacgcatccatcttcagcaggttgcgcccgtagcgcagtatggcttccgggtcttccaccagttccgtggaggtctgccagccgttctgcgggtcggtgtaattcacctccaccgccgtgtggcggtccttcagggcgctgaagctgtagcgaaaccccacgccgttatcatccaccaccacatcactgctggtgtaggccacaccacatctgacggacggtcctgcacaaacgtcagcgtctggccgttccataccggcatacagcgcatcgccgagcagaaatcactgagaacgtcccacgccttacgctgttgtgacaggtacgcattaaaggtcatccgcggctctgtgcccccgaaaccatcagggaccatctggtcgcagtactgcgcaatggcatacagcgcccacttgtccacatccgccgcccccaggcgttttcccatgccgtagcgcgggtgagtcagcatgtcccacaggcaccaggccgggttgttgctgtatgccggtttcaggctgccgtcccagatgccgctgtacgtgcgtttttccgggtcatagtttgacggcacctggatgatgcgaccgcggatatggtagttcaccgtcatctgctgaccgccaaactgctccgcatccacctgcagccccacaatggccgtgttcgggtagcactgtttcacatcgatgatttcggtgtatgacgaccacagcgttctgttctgcagctggtccgtggtgctgtccgccgtctccctgaccatccggatgttaaagggccggggcggcagattatccagaatcaccgacgccaggaactgcgaggtggtcttgccgttaatggtgacatccttttccgtcacccagttaccgttacgctgcaactgaatcagcagtcggacagaagagtgattacggtcgccctttgaggtggtctccaacagtgactgcaccccgaaggtgacccgcaggcggtcaatgttcgcggacgtaatggtgcgcgtcaccggctttgccttcgtcacttccacgcccagtgcggtttcagctccggaggactcaaagccttccggtggtgtctgctcctgctccccggcacgccagaccgcagtcacaccgtgtatcacgggattaccgtccgtgtccgtcagcggggttttgttcaccagaatactctgcagccccttcaccggaccttcaatcggcccttcaccaatggcgtcaatcacgctcatcatctgcgtggacttaagattgtcctttgcctctaccggcgtgtgccccttgccgccccctttacccactctgtccccctctcctgtctgatgtctgaatctgtttatgccagaaaacaacaggcaccccggagggtgcctgtgtcatgacggaataaaatttctgaaactcttcacatttccggcaattgcctgtagccgcaataatgacgctgcattacttttttgatgcctgaaaaataactccataacgttaatcttcatcgttctctcccgcagctccgctaactctgcgggatttttttattttcatccccgcccgataaccaccactttcccgtctccgccctcatcacgggtgctgatgtcctgggatatccgtcgtgaaccaaccagcatttcaccataaggcaccggcatcgggttcccctgggcaatcatgttatccagtgacgaaaaatacgtgttctgtttaccgttatccgttgcgcggtaatccggtgtttttgccttcggtgccagcatctgggccacaccgcccagtatcatgctggcccccagtgaaaacagcatcgtggtggcagaaaaaccaccggctgccagggctgaaccccataacgccattgatgccccggccgtgaagaaagagcccacgatggctgccgcccccagcacaatctgcagtccaccctttccggcnccggccagtcgcggcacaatatggatgaccgnnccctcacccagangttcgtgaagacgggcgtacaccgcctccggtgccgtgtcntcaccgggaatacgtatctggtaccagccttcgttcatctgacggcggaatcccggcatctgcagcgacagggcacggatggcttccgctgccgtgttcacgtacaggctgaggcggcggccaaatcgttgcaaatccccgtgaaggcagatgcgtgccagtggcggtgacgccagacagaatgcgttcgtcgttgccatttttcagaatacctctcccgtttactcagttgttcaggcagatggtgaagcagttcaccgttgccgcagtatatggcggcatgattggccaccgatgcgccaaagcagcacagcaggatatcgcccgcctgtgcagaggacaggggcacccggtaaaaaccagtcgccgccatattgtccaggtaaaggttctgaccgttgcgccaccagtcatcctcacgctcaaaatccggcagcgttatccccgccagatggtatgcatcccggaacagggtgtaacagtccgtcaccccgtgctcaaaacgacgcccggtcaggtgcggcacacagcggaatttatgaatttccccccggcagaccagccaccagggcagggcactctttatctgcagccgccggtcggcctcgctcagccagggcagaccaccagggtggctgtgaaccagcgccacaatctccccctgcatctctgcctgcagccagtcttccggcgcaatacgaaaatacgcctccggctctgcggagatattcacgcagggctggtaccgttcgccctccggggtgcctatcacgaagccgcacgactccgcaggcgcacaccgccgggcatgcaccagaatcgctgattcagtctgtgtcataaaacaggatttactgcgaaagtttattgatggaaaggaaaccgccaaaattagccaccatgccgcgcatctcacacccgcgcatgcacttgctgcatctgtccttacggatatccgtggtggggttgtcgaactcatccgccaccgcaggaccgttatacccgcattcatctccccggtaatcccacatacaggtattcgccagcataatgcgaccgggaaacagcgctccgtccgtctccgtcggtgttgccagcacaaacgaggctgtcatggccgtcagctctgacatctgctccaccacccagcggtcgctcagctcctgctccgggtccgcttccggattgcccgccacaaaattcaccgcatccagaaaacgggcatacacccggcggcggaccaccgtggcccccaccaggctctgcaggtcctccgccattccggtgaccagaccgaacagattcgacaccgtcagcgacgggcgggcactgctgcccttcccgttcatctcaaaaccgctgccgtcaatcgggtatgcctgatattcccgcccctgccaggtaaccgcctcccctttttcattcagctcattgcagaaaaaataccgctcaccaccctgcaccgtcaggtcgatttcccagagcaccacccgcggtgactgctctgatttaaccgactcgatcaggctttccccgtgaatatcctgcatcagttcaccacctgcttaaactccgcgctgaactcaacgcgcaacatcccgacccgcgcagaccacccggcacaggtcacctttatctgccggtatgcatagggtggcttccacaaaaatgctttccagcctccgtgctctgccaggaatgcctccagatgtcgggcctcctcccgggtcacggaaagcgtcacacggtatgttttcaggtcagcattcagccccgccgccatacgctgcgaatacccgtcaccaaaacgcacttcacgcaccgatggctgcgagttcacctccatatccggcttcactttccagcgaaatgttttcatcgcctgctccccgataacataccgccatcacgcaactgcagccggagctcatcctgcgcccccttgcgggccatgtcatacaccgccttcatcagctgcggccccgcctgtccgttggtgccgtcgttctgaatcaccacgtgattgttctgattaaaattaatgccttccgtccgccgcatctgcgccggacttccggcaccgcccacataacccccttccgcatagccccgcatcaggcggtacaggttgccgacgccaatccggctggttgcctccttcgtgaagacaaactccccgcgatgaacaattcccgcaggttcatatttaccccccgtccccgtaaatcccccggtcgcgaaatggaagttcgccgccgcagcctgaatggccgtccccgtggaggcagacgcaccaccaccgaaagcaccgccaatggcgctgccgatacgcccgacaatgcccaccatggcctgtttaagcaggatttctgtcatcatggacagcaccgaacgggtgaatccccgccagtctgcctctgcaccggtcagcatcgccgccatattctgtgcaataccgtcaaaggtatgcgtggcagcacttttaacctgcgaaaaactgtccgtcgcactttccgcccactcgccccagccggatttcagcccggccataccagcttccaggaagctgctccgccgcagaccaggtgttcttcagtgccgatgtggccttcgccagcgcagccggattatcaccgtacacgtcccgaagacgctgcgcttcagactcccgctgcgcctgacggtcagtgagaccgcgggcttttgcgctgatggcggcctgcttcgcgctctgctgctcttcaaaccgcaccgcctgctgtgccagctcattcaggcgtttctggtattcaaccttgtcgcccagctcagccagctggcgtttgtactccagcgtctcgtctttatgcgccagcagggatttttcctgctcagataactgtcgtttcgtggcagcctctttcaggaccgcatactgactttccgccttccataaatcacggcgctgccggctgattttctcattcgcaccgctgtgtttttccagcgtcctgagctcagcttcaagggcaagcagagcctctcttgcctgctcctcttccctctccccggcagagcgcgttttcggtgatgtatgctttttacctgtcagctcttcagccagacggctgacggcttcctgctgccccggacctttgctgacgcctgttgcacgcgaacggttgatgtaccccatttccccctggcgtatacgcgcatcccgttccgcaatggattttctcagcgccagttcatcacgttttgttttctcaataaatacgcggttctcttctgccagttcaccaaacaacgcaccaacgccgggcacattctttgtcgtttcccaggctgactgaataaattcagccagcgccagatccccctgcacaagcagcagcttcacctgttcaacggttcctgccaccacgtcagtgatcagactgagtgcccccagtgtatgatcacctatccatgcccatgcgtcagaagtccaggttttaacatcgtcccagattttttccaccggcgtggccgctttatcaagttgctccagacgtgcattcatgacatccgcaaacagggacatcgcctccgtcaccgcagcctgtttacctttcgtgcgctcaagctcatcaatatggcgtaactgggaaacgctcaggaagttatactgctgattcagggaggccagcgccttcaccggatctgctgcaatcccttcaaaggctttttccaccttcccggcatcgtcccccaccgtctgcagccatctctgagaggtttcccccatgatccgtagctgcccggcggtatatttcccgctttctgccagacgggccagattttctgccgcctgtctgataccaccaccggcttcatcgctgatcaccccggccattttccacaattctgccgttgtggtggcagcagcccctccggtcagggtcagtgaacgcaataaggcccggtcagcctgctctgcctgccangcggcggcagcaancgcggccagtacggcaaccccgccacctgccgccacacgggccaccgacataaatcgtcccagctcaccggcattccgggcattttcagccagtgcatttgccgtatctgacagcgactcctctgatgattcagaggcatccctgatcccgagaagttcctccttcagcagggtaagcaggctgagcggtccaccgaatgaatcgctgatctgccccccctgctgcagcatgataaggaagggattctgaccaccggcaagctgagtgacaatatccgtgaactgtgcgggcagtgtgcgcatggcagccttatactgtccgactgatatcccggctttttgtgcagccagcgcctgtcggctcagactctgctcagcagcatcagcctgttttctgaaagactgactgactttcccggacatcaaatcagcaagcgcactggtttcacccagctctttttttacccgcgctgcctcttcagaaaaacgggcagaatccagtgtcagcacggctgtcagatcggcaaaattacctgccatcgtggtcacctcctgaaatgtcctctgataccatcaataactgtcacaacctccttccctcctccccgaaacggactccaccggcgaggcccgccgccttctgcatcagtacatcattttcgtccggcgtctccgcctgtccttcctctgcctccggagcgaacaggctgaaatccgccggatgcatatccggatcgcaaaaaaacaggctgagtacggcgtacatcagcccggaaaaatgcatatccagctgggtatcctgaaaataatgcgtgcagtaaaaacgtcgccagtcggcatattcggtggatgtcatcccggcaagcatggcgcgccagtcggctctccccatctcacgcgccagtttcaggacaaagttcagctcgccttcgaatgcttttttgatgttaccggctcagtcgcttctgttttcccggttggttcaggatcggcatcgtgccggttatccagcatacctgaaagataaagcacccggttcgttgcctgattcagtgcatcagcaggccatcccagcatcacttcacggcggatctgctgcatctctgtctccggagaggccagagtgcctttgagggaatgggaatgccatagcgacatcgccacaagcagggatgccgtttccagatatcgctggttaatgttgcacgacatcatgcttcgttgtctcctgttgttctgccgtctgaaacaaactttatataatcaaaccgctgcagcgcagacaattcggaaagcgtgacggacacaccgttatattcaaattgttctgttttcagaaacatgtattacctccgtttaccctgcagcgcccgcttcagtaacggtgacttcagccactgcggcgaactgaccatttccgctcaccacagggatctgcaccttacctgtcgccacgccgtttaccgtaattgtcatatctttcacactaatggtggctttcgacggatcggcggaaaccgctctgaacgtcttgtcggttgcactttccggctcaaaagaaaccgtcagggtggttgttttcccttttgccaccgtaccggatgtcggtgtcaccttaattgcagtggccggcgtaatttcgctgcgttcttccgccacggaaggtttgcccacgttagtgactttcaccgtgcgggtgatcacttctttcgccgtcacggccttaccgatactgctgacccagccacggaacacatccaccgtgccatttgggaaacggattttataggcccgcacatccccgctttcaaaccagcctataagccctttctgaccttcttctcccggtttccaggccagcgtaaaactggtatctcctgcagacttctgcccctgcccggtcgcggtccagtccgcgtcttcatcatccaggtagttatcatcgtagggttctgccgtcatctcgcccggcgtcagatccttcaccttagccagtcgctgccagtcatcgtctgacaacgggtttgcataagcatcacccttgccgttgtaaacccacagagtggtaccggcaccttttaccggctcaaggggatttggtgttgccatatcgtcctcacatctcgtaggtaattttccacaggagatctgccgatccccacatcataaactcatcatcccggcggtagtcatacccctgaagattcatcttcagcagtaatgcactgagcccgggaactgcctccagcgcaggaagaattttttcttccatccacatatccagtgccgagtccggttcttttgccctgagaaaaacctcaatatgcagtgtcgcctcccaggttccctcatcaacgaactcgtcagcagcagacgcatctgtcaggtaaacagcaacagcaggcagttcctgttcatcaataaaaaccgggcgaccgtcaaaccagctcaccctctcagaaatattttctttcagggcagacagaactgccgcccgtatttcacggtgtttcatacaccctcccagtcattttcttttcagcaccaggcgtaactgatgcgtcatggctttcatcatctgcgccggtaatttttcccggtacatccggtcccgttcacgttcaaaggtttctgccagcggtccggcagtcgtaatcttcaccacttcgatcggcagacggtggcgtttcggcctccctttgctgtccgcgccggtggatgatgatgcccacggcatacgctgcatcacatgccagcgtccgttagccagccgggtgataaaggcgtccgggatccgtcttttccccacaatcagcacactgccgccccctttcagggccgcacgctgtcctttctttctccgttttctgcgggaaagtcgaacgcgggcctcccccagtttgatggcgggcaggttgccggtattgatgtaaacctttgcgtaaaccttatccggtcgtgccggacttaaccggatgcgggcacggataagacgacggggaacggccagctccctggcaactgaagaggccgttttcgcaataatggcccccgccactcggttcagtgtcgtggcagaggcccggggaacggcacggcgatcaattgcatccagatttttcatggcctgcgccagaccttttattgccatactcattcctgttcgacaaaaatccggggtttaccgttgtacgtgtcataacgggtcaccgtcagtgtgcgccccgcaaacacaacaacatcatgacgggccggacggtaccgggctgaaaacaccaccagtgacaactggctgcccgaaagcgcccccatctccgcggactcttcctccggcatcacgtcgtacacgacgccgttaatctccgcctgtttgcccatcacccgaacggtcgccacgtccatccggcaacacattcgcgtaaacagatcagacattgatttttaccgccacagtggcgctgtttgcaggggcattttcccaggctacccccgctgccaccgcaccgtctgcagccagctgcacaaccccgtccttcagataaaccaccgcgccggactgaatgtcgtcagcagactgtttgggcagcaggaacacgccttcggcaaaaccgtcaccggcctcaccggcaggaatatcggtaatggccacggccaccatactgccgaccaccaccgcagcaccgctcaggatggtctgatctccggcattcaccagttcaatggtggtaccgtcctgtacaaaatttttcgccataatgctgtttctccggacagcccctgtggggctgtttttcaggcataaaaaaagccctttcgggcagtgattgtgataacgcggttatcaggccaccgacgaacgcaccagcccgcgccagtcaagtggtgccactccggcatcaatacggatttttgtggcaatgccgtcagtggtgaaaccttcctgctgatcaatgtatggcgtgtccacaccatccagccaggccacttcaatggtgtcagtgccctgtgccgccgccagataccaggttttcgggtctgccgcatcaagacgcgcttctgcaatcacctcagcaaagttctggatagggttaatgacaccggcgtttgcatccgcccctttcacactggccgatttgatggtctggttcgccaccgtctccagtgccaccggtaccagcataaaggccggacggatattcagggcacgatcgccttctttctgcaggcgcatcatctgacgggccgcatccagtccggaaacggagatccccccggtggcaatatttttgtgatcggcatggaacagcgccttaccgtcggacagtttcgggttatccgtcagcaccttgtagaccaggtcaccaatcgttgccttcgccgcacgccccatcttcatcggcacgtccaccagcatattcagatcatcattgataatggcctggcgggtgatggagaaaatctccccgtaagtggccagtgcaatggtctccttgcgatctgaggtggtgatgtatttatactccgccccctcacgaacctggcgcagagaaccaaaaccgcccatccccacgcgatacgctgttttgaagtctgacaggcgtcccttacgggtccacttctggaaggtttcttctgattcctcccagccctggatcagccccttgttcgacacatccagcagaatattgccaaaatcagaagtgctgtgcgtcagcgccagcccgaccatctgcatggggttataactggccaccccaataccgcgctccgtcagtgacatgcgagcccattcacgcagggtcatcccgttataggcgttatccttctcgacattttcaaatccggcacgggccagcatcgcctggcggatcccgtcccccacaaaattgccgtttccggcataaatatgggccggtgtatttttgttggtcggcgaggactccttgccctgaaccgccccggaaatcctggagactaaactccctgagaaagaggtaaacaggatgactaaaaatactcgtttttcccccgaagtccgtcagcgggcgattcgtatggttctggaaagtcaggatgaatatgactcacagtgggcggcaatttgttccattgccccaaagattggctgtacgccggagactctgcgtgtctgggttcgccagcatgagcgggataccgggggcggtgatggtgggctcaccagcgctgaacgtcagcgtctgaaagagctggaacgtgaaaatcgtgaactgcgccgcagtaacgatatccttcgccaggcttccgcttattttgcgaaggcggagttcgaccgcctctggaaaaaatgatgccactgctggataagctgcgtgagcagtacggggtcggaccggtatgcagcgaactgcatattgccccgtcaacgtattaccattgtcagcaacagcgacatcatccggataaacgcagtgcccgtgcgcagcacgacgactggctgaagagagagatacagcgcgtatacgatgaaaatcatcaggtgtacggtgtgcgtaaagtctggcgtcagttgttacgggaaggaatcagggtggccagatgtacagtggcacgtctcatggcggttatgggacttgccggtgttctccggggtaaaaaggtccgtacgaccatcagccggaaagccgttgccgcaggcgaccgcgtaaaccgtcagttcgtggcagaacgacctgaccagctgtgggtggctgattttacttacgtcagcacatggcagggcttcgtctatgtggcgtttatcattgatgtgtttgccggatacatcgtggggtggcgggtctcatcgtctatggaaacgacattcgtgctggatgcgctggagcaggcgttgtgggcccgtcgtccgtctggcaccatccatcacagcgataaaggctctcagtatgtgtcactggcctatacggagcgactaaaagaagccggattactggcatcaacagggagtacaggcgactcgtatgacaacgcgatggctgagagcatcaatggtctttacaaagcggaggtaatacaccgtaagagctggaaaaaccgtgcagaagtggaactggccacactaacgtgggtggactggtataacaatcgacgattgctgggaaggctgggccatactcctccggcagaagcagaaaaagcttattatgcttccatcggaaacgatgatctggcagcctgagttcacagataaaacactctccaggaaacccggggcggttcacccatttcattcagcagacgttcacgggccatttccagcgaacagtcaggatcagccacgcactgtgcctgaagcgtctgatagcgaccgccgaacatggcaaacagatcgttaatgcctgacatgcgggctttctgctcagccataacgcgggcgcgaatggtcgcctcatcagacactgccggtaccggtgatggttctgttaccgccggtgcagggattgtcactgtggtatcacgcggggcactgttgcgtggcggagtaatcatgtttcggatggattccggcatctttttaaattcctctgtacgttttgactgaatacatgccattgcctcaacagcgggtgtcacctggtcagcaaatccgtgtgccagacattcggcaccggacatccaggtttcatccgccagcatggcggcaatttcatcggtggtttttccggttttctgcgcataggctggcaacagtaccgattggactttatccagcaaatcggcataactgcgcatatcctcagcatccccgccactgaatccccatggcttatggatcatcatgaaggcattttccggcataatgaccgtatcaccggccatcgcaatcacagatgccatcgaggcggcaacgccatccacatacacggtaatggtcgccccctgatttttcagggcattaaaaatggcgatgccttcaaagacatcgccacccggtgaattgatatggagattaatgtgggtgatatcacccagtgcattcagttcgctgacaaactgcttcgcggtaactccccagaaaccaatctcgtcataaatataaatatccgcgtcacccggccccccagcttgcatcctgaaccaggatttattcttcatgctggctttcggtgtcgcgctgatactgtcgttcagttccggcactgttgcctcctttgtcgttgacggggtcagtatcaaagaccagccccagtctgctgttttcatcaatttcagccttgcggcgacgtttgacctcatccggattgcgcccaccggcacgcacccagtcagattctgtcgctgcaccaccccggatctgaattctccaggcttcagcttccttaaccgggtcgatccacggcatcaccggaccggaatacgtcgcgttatatagcgttttcatctccacatccgccggaattttcagcagacctgccgcaaccaccatattcagccatgtccggtacaccgggcgggttaccgcgccaataaaacagtcctgcaggatcaggtaaccatccgtggactcgaccagctcctgccgctgggcgctgtaggtgccgttatagttacgcgccgcactggaaaaactcagacgactgcctgctgccactgcacgcaactggccgttgcggaaagtttcaaggttgggattgggacggtcagatttgaccatgccgatatcctcgcccttgcgcaaatcgtcataaataatacccggggtgatatggacttcccgctcggtctctttgatccccggatcttcatagtcctgtccgtcacctttacggatatacagtcccagcgccgcagcaatacgcgccgctgtcagttccgcatcctcatactccttaagggcactgatccgcatcagcacccccgataacatggatgagcctcgcgtctgatgcagacgacgagtgaacttcaggtggatcatttttccggcagcgatttctttcgtatcactctgccggccgctgaccggataatttttataaaccagatattttttcggtcttccccactcatcaagaaaaaccccctgattcagtccggcggattcatcagtgcgcatgggaacaaaatccggctccatcgcctcaagccagaatggcactcccgccgtccgttccagaccgtttcccgcaccactgaccatctgcgcaaacacttcaccatcccgcagccaggtccgcagcagtaaacgttcaagcacaggacgggtatactgccctgtcacatccggactcacggaccattcagcccacaaacggcggatatccgcagccagttcagccgccatttccccgttttttcgtaatggctgaggctccacaataattcccctggcaccaatcacccgctcttccagcttgtcaaacacaccaatcaccaggtcatgattgatatccagaaaacgggcctgctcccgcagggaaaccgcaccgtatttactgagctgatcagcagagcgattttcccgccgggctttatgtgtccgggtcggtttcaccgcctcataggccatgattaacgcccttgaacgcagtctggctgctttccacccgggggaaaacacgccgatcacatcatcaataattgccattaaaacctcgccagtttaaatcccggttttccccgcctgcggctcaccatcgcggcaagcctgcgttcccactcctgacgtccggcgcggatctgagaaaggctttccagcgtcagttgctgcccgttgaagatgacagactttccctccagtacggccatttccgcttcacggtaccgctgtatcatttctctggcttcttctgtgctcacaaccagcctcctgatgttatccatggattatcttccgcacgctccgtccgcagttttttcttccggcgacggcgtttttctgccccggccgtcagttccggggataccgtttcaccagaacgctcctgcgggaagacgagccacgtttcccgctgtgcccagtccggtgcggagggccagcggatcttttcgtaaccatgcagaacggcaagcgcatccgcataaaccagcaggtcaaacgcttcgttagcgcccctgcccggttttcgccattttccgtcactgccgcgctcttcataggtcagctcatcgtaaaaccaccgccccagccagtcgggaaagtggatatagttcggccctggtgtgtcacgccacagggcattatttacacgatccttaaacgcatccgtctgaaccagccacagcgcgacatcgccactggctctggcacggcgggcacttctgccggtattatccgggaaggttcggttaatcagcctgtcacggcgaagtccatcccccttgaacagaaacaccctgttgcccagtccgtcactccggcaacgacgccagaaacgataggcgttatctgtcaccccggcttcccctcccgtatccaccgccatggccatcagacgcatgcgcacatccggatcagaagccagcggccatgttttatggaacacatccgtcagcaacaaatcccagtcctccggatatgccgccggatcaaccggcagactttcaccgttgggactgcagcgcagtgaatgccggatgttgtagcgatcaacaatccagcgttccccctgctctccgtatccggtgatctgcacaacaaaacggcgatttttaccgccctgtacgtcaaccgttgcctcaataaaacgcacaccatccggcacagatcgccggggaaacggctcggcacgctgttcaagcagttcacttttacgctgttccgtggctgaacggggcagatagggtcgtccgatatcggtgttcaccaccgctttcagggtctcttcactgccggttcgctcatactcttcttctgccgccagcagtttaaaaatcagttgttcccaggtctgaaacgccgcagctggcccctccatccaaaatgacgcaatccgggagtttcgtggcgttccggtgatactgccgtccgccgccgcccgttcaccttcacgaagccagatcccctggttattcagttcgcgtttctgctcaggggcaatcagcccgcgacaatgcggacacatcagacgggcagcctgaccggcagccacaaaatccgggttattccggtatccggtcatgttatccatcaccggctgaaaatattccccgcagtgcggacacggccagtaccaccggcggcggtctccccggttatacagtgacaggatccccgttgttggcggtgcctcatgtgcgccaccacaacgccatttggtatcggtgatatcccgccccggtgaactctcgaccagggtcatccccgaggacataaaggtggtggtacgctttgaggccagcgtgaaggcatccccttccccgtccacattttcagggaaacggtcataatccgtcagcgccacacgacggtaatccgaagaggaaaagacggtgatcgacggccagccaatcttcaggaaggagccgtcaagaaacattttatcgtggacgttgttgtcattacgggaaggactgaggcgcttgctgacctccggactgtggcgaaacgtcctggaaagacgcgttctggaatgctcacgcgccttcgtctcagtcatctgcaccaccagcatatccgccggatcacagatgatgccgtacacaatccagccatcaatcagcccttcggttttcccggttcgcgcaggtcccacaaacaccaccgcgtcatattcacgggctgataatgtattaatggggtcaatcatatagggcgtcagcgatgactcccacggaccggaagtattggctccccgtggaacccgcatataacgcctgatggcttccgctactggtaaccggctgggtgggcgaaacagcgaggccacttcgcgccagatatcggatgcgcggctatggctctcgttcacctgattcacatatcggcctcatcacaacagtcaatgactgccttttccagtgtgtcgcggatctcatcaaccacaatctgtacttcattcagttgtgatgcagtccaccccctgtccctctccagccggtcaggccaggtttccagtacctgaactatcgctttcaccacgacagaaaaggaccgcctgacatcactgactggcacaagctgaacagtttcatgctgaaatttaagacgctcgcgctcggactgataccatgccttacgagcgtgaggatccatatcctcatcttcggaagatggtggtttttccagcaacgaagttatcaaatccgtcaggagatacagttttttcttttcattactgcctggtgcaagaggaacatccgccattctggcggcaacagtctgccggtgcagacctgaaagggctgccagttgattaatatttaacttcatatttttcagctcgccgtccatttacatccctccacataaaccgcagaacagaagtgactctgtttttttgtaaagaaatgccgccatataaagatgtcgaacaaaaaacaaccacaatcatcatctttttaatactaacagcattaaaaacaacaagttaccatcatgatgatgatgacgataaaatcacaaaaatgcgcctttttccgcgcccgcccgccccgtgttcaggcccaccccaccaggaggacccgcaaaatgataatggttatcatttgcaacaaaatccagtttcttccaccatcgcaccggactggcgactatgaggggacaacaccgcgctccgttaacgcggtaaaccccggtgtgtatcgtttttgattatccccgcacactctcgcagaggagtctccctgtctggctgcggtctctgttaatgcaggaatacggtgacgatacggcgcatcagcaaaacttagttcaggcactgagtgcggatatagtcctgtgccccttccagctgcttctgcattgtcatcaaccgttctctgaggatgaaataatcccgttcagcggtgtctgccagtcgggggccggttgcattatccacgccggaggtgccggtggcttcacgcacggtaccggagcaggtggcgttgatccgcaggcgcttacgaccagcggcaacatcagcacgcagagtttcattttcagctctcgcatcggctaactccctcgagtattttgcatcgagcgcagcaacatcacgctggcgcacctgcatgtcagtaatggtggcattcgcctgttccagctctctggcttttttatcgcgctgcgctttgtaggtgagcgcgttgtcacggtaatggtttgttgccagccacagcgcaccatagccaaccgccaggacaataatcaccacacacagaacacggttcatctctctttcaccccaccagtcccgataacgtcaggactcgccaggcggtggaaaagaaaatggcaaccagcatgactaaaaatgaaatgccgacaagtacacagaggctcttcaccagcgttatgagtttatctgatatcattagccaccccatcaatccgcctttgttattttccctttgcctgtatcagccaggacaaaatcaatcagcatattcgcttcatttaccagcgtacggatttttgatacatgcgcggctttaacctgtttccactcattcagcccggtagcaaacacactggcaatgtttttatcccgtttcatgtcagcacaagcctggttgagttcttccatcacgctcattttacggggattaacgacaaaacccttcgtccagtactcgtaaagaacatcgtcgcactcttcctgataccggatgaccttatcgcggatttcgggttttactttgttgggattaatggtttgtagccagccggcaagttttcgaagtggcatggacaccatattgcgttgtttcccatcctcagcaaccataacgatttccgttatagttgacgcaaaacgctgtcttaacttagccaactgtgattgccaggccagccccatccccgcaacgacaggtttcatgggaacgtatggttcgccattatggttaactacataaagagagttgccgtgaaacggcacggccatcatattcatcggttatttccttttagtgatgaaccttgtctcacaggaatccagcccacagaaaggcaccgacagccaaaccggtatcctcaagggtcatcctgaaaggttctgtgttgtgagatgcgcgtgagatgcgcagaaatgacaaaggcatcattacggtgcctgagtgttaaacaactgctttgactttattcacttacattttgccaatttgcaggatttcgtgttatccgtccatgtaagcaaacctcatttttcagcaaaatattctgcttatctgtcgattccccagcacgccagcgcgctctcctggtcacgacgggatacctgaccgtaacagttatttgagcgaatacggcagtccctgccaccgtccttaatccaccagcgaatcgcttcgcaggcaccttttcgatctcctgcattaatccgtctgtaaaacgtcgacgggaaacacttaccggggccaatgttgtacggacagaatgacgcgatccccgctttctggggttcggtcagcggcactctgatgtttttctccacccatgccagcgccttatcacgctcaatggcgttaacccggtcgcatttttccttcgacagcttcatgccaggaataacaggcttaccatccccccgggtggctccacggcagatggtccagatacccgcaccatcacggtatgctgtggtgtggttaccttccttttcatccagaaactggtcgaggatttcaggcgcagacgcccctgcaccaatcagcgccagaacggcagccgacaggccgtatctgatttttgcgttcatggatatttatcagggtttatcgatttcaaatccctggatatgttaagtcttcaggccagcggtggagtcttcagagaacccgtaattattcccggtagttttcctctgtaggttatcaacacatcctgcgcctctaaaattacgggacgcttttccggtaacggaccatccccttcacataacccggcagcaacatccatgaaaaactgcttcgcctgctttttcgcctcagcttcgtaaaactccagcgtggcaccttcagtacggtcaagactaatcgccacatgtggcaacaacaacgacggatgcccgccaatttcaagtgccacagtaacggcaatcttatccgggtaattatttatctctttaacaaccagttcgtattttttcttcatcactttactctccccgcgccgccttacgccggtcttctttaatcttgaaatacaggttcgtcagatatgtcagcagcccaaacagcagactccccagcacgcctatcgccacccactgggacggagagactttgtccagcagctgcagtaaccagtatcccgtccccaccgctgacgtggtgtatgacacacccgttgtgattttttccatctggtacataccccgtctcccgttatccggaagctgacaacaataaaaaagccaccagttaactactgatggctctgataactcatgcaggcgtctcagacgacccactgacactaccggtgagtttaacgataccttccatttgactggctcactttttatgatgatgccggtgcatttatctccagcaccagactttctatctcaacgccatacgctgcattttttgtaacatccgtcagcgtcagcgcattcagtcccagtgtcagactgtcttttataacctggaatgccgggccagccactccattcagtttcggagtaaccgtggcactgccggcggtgaacaccagctccagcgtctgccagtcgttaccgtaatcgccgaactcccccagcttcgtgtttccggctttcctgtgatgcatcagattcactctgccgtcagtggtctgagtgaagtacgacatcaggaacggattaccggtacccgtcatcgccacaccatcaggaacgggagcatccgtatacagataaatccccagcccgaactgattgttggtcagtgcgcctgacaggcggaacttacaggtcagtctgccgccctgtgtcagcagggtaattgcgtcatccaccggatgcgtcagggaccaggttttattgctctgcctggtgatcttaaatacaccatctgacaactgaattccgccatccttaatgctccagccctgcgcagcagcctctccggctgccggcagcagggagattgtgcgaacggacgtatctgcagacggacccgatggcgtgttgccgccgggcgagggtttgatttccggtgccttaccactgatgaaggctgaggtgcgcccggctgcgttcagaatagcggttgccatacgatccggaataatgctcctgcgcgcccatgaactgaaatgtgtcgggcggtttgatgatacctggtttccattcgttctcgatgccgcaccgtaatatcctgatgccggaatatccggatcttctgccggcgcgttagtggcggtattgacgccgttaccgtctgtcatgaagggcacaaaataaacgccctcactctccctgtttttatacccgccgtacacggtgtcgtactgggtagcgtatgtatttttccagtaatacgtcgtgtcaccacaaatccacggcacatctgcagcgctgccaccatggcactgcgcgttaaacacggagaggtcagcacgaaactgtgtcagcatggctgtaaacagcgcaggttgctgtgcgtgggtggcggcgctcatgtcaaactcaccctgcatccagcagacggccagcagaacgtttttgggatttttctgcaatgccgcttttgtgcgggaaatcagatcctgatataacggcttgcccaccccccagcgtgccgaatcctgactggcccccgtggactcgctgaatgtcccctccgcgccctgggtaaatgccgaaccaccacgacagcatggtaccagcaggatccccgcgttattcgggatatacgggagcagttttttggcaatatgtaaaccctggccgacacagccgtactgccctttgctcaggtcagccctcggatgattcagcgtactcatatcctgcacatcatgcagacagtggtcagccggaataatatcgttatatctgcaggcagccccgcccggcgtcactgtactgcggcgcgccagctgtttaatgcgcggatccggagcatcgtatgaatccggcagcggaagcccttcaccgtaagccatggcattggactgcccggccagtacgatgacgtagtaccaatccggctcagatgaagggccgacctgtggctctccttcaatagccaccgcctgcatcagtgtgtacggcgtaatggcaaccggtccgccgtatggctgccagccctctttcagtttgtgtgtcagcttttccgcaaggtctgacggcgacgccgccctgacaacatcataatgtttaatcgacatcgaatttctcccgtgtagaggaacagagttaaaaagccggaagcggaatcaaatcacaggatgaccatctgccagtggctggtcgtaaaaaaaggccgcgccatgcgcagccgaaaataaagggataacgatgatagtttgagaaaaacagaaataacacttttgtggcaaagcatggtgccgggtgcctcccggtgaattcagtatcagcacctgaatccgcgattaccccatattccttcttgctgattgccccaccgcacagggggattcaccatgcagaagtgtttttaataaacagcaaacaaaaaaatcaagcattatgcaggctgtttctttttatcaccggccacagcaataccataatgccgcagaccagcaccccatccgccagcaccgacatgattctgctggtgaaatccaccatcaccaccagaaacagcaggagtgcagccacagtcaggcgcagttttaccgtcacaggtaattctccagacgaagacccagaacaccggcaatctcttccagcaccttgcgctcttccggctcaatttcgccgtctgcctccgcaatggccaccgccacatccagcacatcttccgcttcacgcgtatcgtgtttcacatcctcgatctcacgtaacgccgcacgacgaccagttttaaagttcgtatccagctgaccgataatggttgcgctaatcgcattaatttctgacgtaaacgcgtacagcgcaggctgattacgcagtacctgttcgatcttcgctttctcggatgcctcacattcaccatctgcacaggccaccaggtatgcggcgttaatcaccacctgtgccagatcgcgtttttcaaactttttaatttccgttgccgctctgcgggctttttttaccaaaaataccaaacatcgtgacgttcctttgggtgggtgagccaacgcccgggagcgatctgcccacagagaaagtcacactgaccactccataagctccccccgaaaggctctgtggttggtatgcgccgggcgtggtgcggatacaaaaaaggtccgcaaaagcgagcgagggaaaataagtgtggtgcgttgtactgggttcgaaccagtgaccgattgcttagaaggcaattgctctgtccggctgagctaaaaacgcagaataccgataatggaccgccatcggagactcgaaccccgcgaaaccagcttcgaaggctggcgttctatcccgatgagctaatggcggtatgtgatggtggcccttgctggatttgaaccagcggcctggcgattatgagtcgctcgctctcaccactgagctaaagggccgggcgcaggataataacgttacgaaatcaatgttgcaagcattcaagaatcacctggttaaaaattacccttgcttcctccaccagcgcattcaccatgtctatccgagataagtggcacaaaaaaacccgcttgtgggcgggttttgtttgcttttgccatcacgtacaaaatcggcaaaatatcagatttgcatgaaatatatgcctttcaatctacttttgcaacactttgctttgaaaatgccgccttttgttttgaacgcgttctcattacaaacaataaagcctcactatccagtcggtgaaaaatgtgtttcattgcaacccagtgacgagtaaatgttttggaccagtttttagttgtcactcccaccagtaatgccagctccttgtattcataaccttccccaccaaaaagttctgcttttactgcctgcgccgccagccagattaattttttcaggcgttcctgcgttttccctgcaatttttctggtaccggattgagtattaaattcattccacgcccactgtgttatcgcgatctgatattcccaacaaatactcccgctgtaacaccacaacaaccaggctttatgatgttcttcaagagacagaacagcccgccgccacgatgatgtcgaaaactcaaccggactgaccagaggaattgacgtcaccttcgccagcgattgctttcccgggattggtggattatcccgcgttatcatttttccagtcacttcatcgcggtaccggattttttttcgcctgtaacgccctgtatcgaacatggcattctcctgccaggcttcaagctgaccttttgttgccccactcaaatcggcggtagcgataatgagcagctcacgcacaaactgtaaatagtggttattcatgcgcactccagttctgtgatttttatccccagccgctcaccaggaacgagctgaccgcgcacaatattgatttcatcaaactgctcatcgtccattagcaaccccgcatgcgtcagcgcatccagcggcgctttcagaatattgtccaggtcacggcggcgcttatccggtggctcggcaataatctttatcgccagccttccggacaggcttaatttcagccgctgctggcgaacaataagcgccacagcccggcgataacgctcaccggcttttgatacaaaatatgtgctgccacgacgtcgccagtaggtgttcaccgtcggcgggtaaggtaaaaccaaatctatgagcatcagtcacctcttttacccgagcacgccagtcgcaaaggcgtgatcaagaaaacgaaaaattaactcaatctgagagccgtactttttctcaaactccagcgggtctgcatgaagttcgttgtggtgctcccggcacaacggtagcgtgaaaatatcgtgggcctttgtccccattcccccctgaccatgaccaatcaggtgatgcggatcgtcagcaggcttaccacaacacgcacacggctgtgtctttacccagcgcgtgtatttctcattaacccagcggcaacgtttaggccgcctcatgaacgattcaggagactccggatcaacggcgatactgacaaccgtttttttctgtggtggattttgttgctggtggacgtgaagtggcagcgcaatattttttgtgcgctgcttcagtatgctgatggctgtctgttctcccggtacgatgtcactctcacggtatacggagcggattttttccgctggtaatcccagcgaacgacgcgctactgcctcaggtagtgcatccaccacctgattgcaggccgcccaccaggataattcagccagcgataattcacgctcctgtgtgccattcattgcgtgacgaatgacgtcaatcatccatgctgacaggttttggtgagcaagttgctcaagtgattcggaggtctggtcacgcaactggttgtcgcagtgccagcacaacaccattgcgccggtaccataacggtgaatgacggtttcactgtggtgataatcgccgtgtggccactggcaggatttaacatggcgcagtaaccagtcagacagtgcgccagcgccaccagcagcacgaatcactcgttcgtcgctgaaaaatggcagtaatgatttatcctccgccagcggctggcgaacggcaggaacgaccccggacggcagattacgcatgcttttcggttccggctccaccagtacccgggtattgtggaataccggcatggattcacggcccggcttaacgatcaccagcccgagttccggtaccagaacaggtcgaagtaatacccgcacgttacctccagatgcgttgctggaatgtgcgggacggacgcggtgggcgttcggagtaaggaagcctgacggagattatccagtgacgataatcgagactgagggctttcttaacctcgtatccgcgcctgcggtaacactgaatcagccattcagcctgttcttcggtgcaggggtcgtgctgataccagtcagatttgaatgcatgagaacgccgcccgtgcctgctggcaggggcggcagagttatccgaattgtaaaatttggtatcgtgcgccatctgttttctctgctggcgcagcaggtgccagttgttcaggctgacggatggattgtaaaccagaacgaccagaaaaaacaaaacccgccgaagcgggttaagtgcgggtgcgttgaggatgcctgacacatcagcggtggcgagggatttctcccccgcctggtctcttactcctcaggttcgtaagctgtgaagacagcgacctccgtctggccggttcggattcgtacctcgcagaggtctttcctcgttaccagtgccgtcactatgacggttaaacagatgacgatcagggcgattaacatcgccttttgctgcttcataacctgcttctccttgcctttcggcgcgtaagaggctaacctacgtttgtgaagcatagattgggcctcagattaatgttaagcgtcttgcaggacgcgtaatgttaactggggcttttctctgtctgccttacggtggcatgcccgaggcagacagcctcaagcacccgcagcaattctacttaactctcgctttacagcaaaccgttttgcccgatatgggaattcccatacggaatgaattcagttccccaggcgctccatcaaaaacacaaccaggcagtaaacacccacaacagcaataacagccagagcgccttccattaccagtgaaatatcatccgacatattccctcccttggtgtgaatcccggcgaacgtttttacccccaccgacaaataacatatactagaaaagcaatagctatagcaacgcctgcaaatgcatctggccggctcattggttctccccctgtgtcgcttctactgcgatctgactggcgtattcgttaatggtaacgataagttcttgctcggcctcatccagacaactaccgatacctcgcctgtccacttcagaagcatcgaaatctgcacgaagcctggcgaccttcaggattgcggacaacacctcatcagggattgccggagagttggttgacgtttccgagattatccgaaaattattggttgacgaacccttattttcccgaaagtttccagcctgaagcatggcggcgcggtgacaccagataatccagccaagcgccatatcccatgccatgtattctctatcgccattttttgctctgcggcgatctacagattccccgaaacgcttctccataaataattcataggctgcccgttcatccgatactgatgccagtgatgccagtgcaatttttaatgcggtaagcatgttgttttgatcttcatcgagtccgaacggtatttcatcccgtgatgactcaattccggtaatcgtgttctgtagccattctttggttaattcagtcatttttcactaccgccctttcgggcggtctcctgatgttctgagggtgcaggaatccctccggttaaggatttaataaaaatcatttctgatttaaattttcagtgtttagttgttggtttatagcctttatgcttcggccttatttctcagccatacacaaacaggaccatcttcggtgtcatgtatcgaaccgataaaccatccctcaccttctggtcgctcaggttcccatgctgaaatatcagggccatctgcgtccagattaaaatcatcttcatccatactacggatagcccactgaagattatttttctccatccaggcgttaaactcttccgttgaaatatattcccgaccatcacagaatttttcatattcaggatgcgtccagcagccatattcattacgttccactggcatttctttaattacgctcatttaccccccttatttaattttctacgacactttttacaatcatctggactttcgaatgtatccggctcacgctcattgccaaaatacatccacccaccgcaaatacttgttatttcaccttcagcaaaataatgatgttttttcgccataagtggccttgcccagcccggattcgttttactcacttgttgcctcctttgcgaagctctgcgactaactcgtcacatatgtgcgtcaaagagcaaagtttgattgctggatgttcgcgcaccatctccacaccctgcgcccgcaattctgccagaaaagcgtaggggtcagttttttcactgtggtacatggcatcatagataatcattgcagcgacacctgcctgtcctgcatctgtgacggatatatgctcaagggctacggccattgcgtgtttcaacctctcattttccacctcaagcaccacacgattagcctccagctcttctatgcgtttttttgctgctcccagctcaacacgcagctcctgatagttaatctcgctcattctccttcctcccgcactgctgttttatatgcccgaagcacatgcgatgtttttcctgacacagtgcttctcagaaagaaaattccactggtgtttattaccagatacgggtcagcaagacgcagcatatccagtatgtgattatgttttcttgtttccagcaccgtacttgaaataagcatatgtgacacggggccgaaatcatgatatctgattttcatatcatcaccctgctgtaaaaattacccgttatctcctgtcgttattttctgtatgacatcacgatgcttattaatttcccgcagcgcggcgcataagcgctcccacttctgaacctgaccttttgcccggcgcagctcgcggttagccacatgcagcgatggtaaaatcagaccatccggatgctttctgatgaacgacgactgtgactgcactgtgaccgccacactttcagttttaatttcttcctgtgtttccgcttcccggactggtaacgcaacacctgccggctgaggaaaggctttaccatcggtttccgttaccgatgcagctttcggctctgccggtaaattatcgcccggtatgcagtaacgatatttaccgtcctgatttacgcgaatcagacgacctttgctgacagccatcgccagtgatgaattcgcccggcgggaggtaatcccgaacattaacgccagttcgtcagccgactgaggaccatgctgttcaatcgcgttaatcagcatctctgcagtggtttttggggccgcttcagttgcctcactcgtcagccaccacatcgaccccttgttatcagcttcgccacgacgcttcagcttccagagttcggtaacagcatcgtcacggctgatttcaagacgggctgcaatctcgtgcgacgaggcttttttcagtgctttcagtgcgtcaaaaacggtttccattaaattttcctcccggtaaaaattacttctcaactcagacaaaaccggccgccttccggcgctcatattcctgtttcagcaattcaattggcgttggccctggcgggcgtttgggtgctgccagttgtcgccggactggcggaacactgaggccattaccaacatgctttgcccatttcgtcagctgcctttccacaagccgttttaactccccttcggtcatctggcgctcaatcccctttgaacgcatctcgaggcaaatgtggtacagcaccggctgtggccacgggtatttatcactcccgtcgtaccgccaggattcattcctccagcgacggtactcctccatcacggcatccaccgtcaggccaaatggatttgccccgctctccgaaatcaacgccacaaactcagccagatccggaggccacgtttcacccgcccggcagcggtccatgcactgacggcagacctgccggatttgctgttcagtcatcgcgccaatctgagcaatccagagcttcgacggcgcagccccgttcttctgggtccagcggttcgaatacacctcccccataagttcccacagcttccaggccgtttccgttgctgataaatccgttttcacgttcccactgttcacgtgctgcccgaatttcctgaactgcccgtgatgcggtgccacctggtgctgcatggcttacccccttgctgactggttttacctgtgccctgacgtgctgcacgtgacgggcaaatttctgctcccactgaacctgcgtgaaaaccttcccctccgccatccagtaatcccggaatgcggcaagctcagcaggtgtaaactcaggctcaggcagagccataccccacactgctgcccgctgtcgaaaatccggcgacggttgccagactccagtcatcggaaatttcccgatcggttcgctcaggccgtccaggtattcaggttcggctgtctgcaacgacgcgtcattcaactcaccggtcgtagcactctcgcgcatgcgcgcgttatgtgtggggtttaattctttatctgtatctgtatctgtcgtgatttgtcgtgacatatgcgtgacgcgtcgtgactcatcgtgacaatcagtgttctgcttccgcagtctttcccgctcccgctgcgctctcttgcgctctgccggggattttgcggtttgcgaaacattaccgttatcctccttcatcacctggcgtttttcccatccggaaataagatcaccatccagaactcgcccctgcattgcatgcaaaattgaatcaatcacgtcttccgtcacatcaagcgcacttgctaaatcttccgtcgtgacatcaatgtgaccacgtagtgacacgccgtgacatgtcgtgacatttcgtgacgcactcaccagaaggtggatatacaccgccatcactgttgcgattggctgtcctgagaccctggcaatggttcgccatttgggatcatttggcatgtcatgccacaatctgagccaggcattagccatactcacctcatctgataccgaactttaccctcgaacatccggaagaaatccggcatgaatattgttggtcaatgcacgacaacagcattaccaggctgaccaccactgttagtcagggtgccccaggcgatcgccgctgcgacaaaatcatccacatctttcaccagccgatccctccgttcgacgatctcacggtaatattcagagctgtgactgcgcatacgggccaccagcagaggcggcattgccttttcgatcgccggtaacagagcctgaattttttcaacagcatcaggggtgtctttatccagccaacggaaaattttctgggtattacgagccagggcttccggatggctgtcgtcgtacagttccgggaacgtcatccccagctcgaaataagtccgggctatttcagctgcaggaactttctcaccgtccggataggcccaggcattgatcgccatgcggatgtgctcatgtttgattttcatgaatccccctttccttcgccctgagtggtatccttctttttgtaaagttctgggttcaaagataatttccccttggagtatgcagcagcttccgcagccctccccttcggaactatttcaccaggacgcttacgccacatgtaaatagcttcgcgggttatcccataaaaatcggcaaccctctgaacagaaccaaaaaactggacaagttcatcaactcgcattttacctcccaaatctaagtatttttagattacaagataattttttttaggtcaatgcaatctaaaataatttatattcaatttgcaggagaaaatgatggaaagccttggcttcaggcttaagagacttagaaaagataaggggctgacccaagtagaactgggtaagctttcaggcgtgactggggttactatagggtactgggagaaagatctaaacgaaccaggtagcaaagctctaagtaagttagcccaggcattaggaactactgagtcctatctcctatatggagtatcgtctcctgaattatcttttgtacaaagtacctcaggcaccaagatcccctacctttcgtggggtgaggcgatttctttcctaatcttaaaaggagagaaaacaatgggaaatgtcgatagaatcaccacattctttgatgtcgaggaaggtgattttgccgtttcaatgcctgatgacacaatgcataacccatcaggatcaccgagtatcccagttggtgctactgtgatcctaaggccaggagaaagttataaaaatggcagcatcgtcgctgtaatagttccggatccgcttaaaaatgaaccatctatgactataaagaaattagttattgatgggaagcttgtgtatttaagccctctcaatccacgctatcagtcatcctaactaacaccagagtgtaaaattgttgccgtagcaaaaggtgtacagttcaacttataacccgccacgtcctttacttgaggtcggcaatgccgaccttttttttaaattaatctagatttaccttgactgaaaaactaaatacttttagatttattacataccaccctacttcgccccacagaangtcgggcaatacttcgagttacccggcagtggtcaggggttaagtagccagcccgaggcgtatgaacatgacggcgggaacactttgtataacagcgcagcaggtttttagttccgcgacccggcgttaagggtaaatgaggtcaacatggatatgctcaatcttggcaacaatgaatctctggtgtgcggagtattccccaaccacgacggcacgtttaccgcgatgacgtataccagaagtaaaacgtttaaaaccgaagctggcgcgcatcgctggttagcaagaaacgctaactgattagcgccagtaaaaacaggtttccacaggttaatttaccctgaaaagtcagggcataacacgaaagcgcacggcgaagttagtctctctgtataggtcgtcgttaaatttaattcgaccgtgcgcttctggttgtggcaatccgcgaaatggcgcggcggtaagtatggcggggttattccttcccccgttgaggacaccgggttgtcaggttgaccatacgcttaagtgacaccccagccacaacaacctctgttatcacttttctggtgattcggcggaaatggatatccgccctttttaaagtgaattttgtgatgcggtgaatgcggctatgcgcacgcggaacagttaaagcagtaaggcggtcttttactggcgtaacgagcatcaactaacccgacgttaattgttaactggttaacgtcacctggaggcaccaggcactgcatcacaaaattcattgttgaggacgcgataatggaaacgttattaccaaacgttaatacgtctgaaggttgttttgatattggtgttctgctcagtaataaagcgtttactgaggatgccattaatatgcggaaatatgagccttatctgctcaatgataattccattctttcccgaattgcccttattaaacttggtattttcggagaacgtcaatgacttcagcatttgcactggtgatgacggtttttcttataacgggtgaatcacagaatgttattaccggaatttatgccagtaaagaatcctgcctccaggcaagagacgagcaaaaaatttctggtgaatgcctaccggtaaaaaaagtatcgctgtacctgaataacgaaacaccggctggataacccgccagccatattaacgccataccaacggattaaaaatgccagcaatggcagggattcgttcaccctgaaatctgtaatgaggttaaaacacaatgagtaaaatctttatttgcgctgctattcctgacgaacaggccataaaagaagatagcgctgttgcggtggccactgccattgaagccggtgatgagcgtcgcgcacgcgcaaaatttcactggcaatttctggagcaattcccggcagctcaggactgcgcttataaatttattgtctgcgaggataaacccggcataccccgccctgccctcgattcctgggataccgaatatatgcaggaaaaccgctgggatgaggagtcagcttcctttgtaccggtcgaaccagaatccgatccgatgaacgtcaattttgacaagctgtcccctgaagtacagaacgcagtcctggttaaattcgacacatgcgaaaacatcaccgttgatatggtgattagcgcacaggaattactacaggaagacatggcaacattcggcggacatatcgttgaagcgttgatgaaaatgccagaagttaacgccatgtatcctgaacttaaactgcatgccatcgggtgggttaagcataaatgtgagcctggcgctaaatggcctgaaattcaggcagagatgcgcatctggaaaaaacgtcgcgaaggtgaacgcaaggaaaccggaaaatacacgtctgttgttgatctcgcccgcgccagagtcaaccaacagaaccctgaaaacgctgctgaaaaaaccggggctgtcactgttgccattcgccgcgaatacaaacagacatggaaaacantcgacaatgaactggcctgcgccctctggcccggtgatgtggatgcaggaaacattgacggtaccatccatcgctgggcgacaaatgaggttatcgacaaggatcgcgaagactggaagcgtatctcagcatcaatgcgcaaacagcccgaagcacttggctatgaccgtcagactatttttggccttgttcgcgaacgtccgatcgatattcacaaagatcccgttgcactgaacaaatatatcagtgaatacctgacgacaaagggcgtgtttgaacatgaagaaacagaccagagctctactgatgctctccagccgtcagcagcacaaactgctccagtggagacggcagaatccgatactcaaaaaaatgaaatcctggtggaagctgaaccatctgtagagcgtgaaggaccattttatttcgtctttaccgataagggcggggaaaaatacggcagggcaaacaaactttctggtctggacaaggcgctggctgccggcggtaccgaaatctcaaaagaagaatattttgcccgaaaaaatggcacatacacgggcttaccgcaaaatgtggataccgctgaagattccgaacaatcagagccggtaaaagttaccgctgacgaagtaaacaaaattatgcaggcagccaatatcagccagcctgacgccgataaattgcttgctgcatcacgtggtgaatttgttgaagggattagcgacccgaatgatccgaaatgggtgaaagggatccagagtcgcgacgctgaggaccagaatcagcccaacgtgaaacaaaatgagccagaagcggaacaaaacagcccggatacgcaacaaaacgggccagaagaacaacaaccagaaccagcagtgcaacaggaactggaaaaagtttgcaccgcatgcggtcagaccggtggcggcaactgccctgactgtggtgcggtgatggggaacgcaacctacctggaaacattcgatgaagagaatcaggctgaagctcagaaaaatgatccggaggaaatggaaggcactgaacatctgcacaaggagaacactggcagcgatcagtatcacgccagcgataataaaactggcgaaacagcaaatcccttaattaaagtgaacggtcatcatgaaatctcatccaccagcaggttgtggcaccatctgatgattgaccttgaaacaatgggaaaaaatcctgatgcgccaataaactctatagccggtaagttttttgatccggcaaccggagagatggggccagaattcagcaaaactatcgatctggaaaccgcaggtggggtcatcgatcgggacaccattaagtggtggctgaaacagtcacgcgaagcacaatcctccattctgaccgatgaaatcacgttggatgatgcactgctgcaattccgggaatttatcgacgaaaactccggtgaattttttgttcaggtctggggtaacggtgcaactttcgacaacgtgattttacgccgttcatatgaacggcaggggatcccctgcccgtggcgttacaccaatgatcgcgatgtaagaacgatggttgctctgggactggtgatggatttcgacgcaagaacgactattccattcgaaggtgaacgccataacgccctgcacgatgcgcgttaccaggcaaaatacgtttcagccatctggcaaaaactgctcccgagtcaggctgatttttaatgttcaacccggatcgccgctaacggcatatagttagcggcggttgtgagatatagctatgagcagcatatttttaaccgaaaatgaattgcaaacgttaacgggctgcaaatatgcaagccaccagcgcaactggttaataaaaaatgggcttccgttctataccaatcgtagtggaaaaccgatcgtcagtcgggaactgtttacctgtataaaaactttaccaccacgtgaggctgaacctgatttcggtgcgatctaatgggaagacgaaggaaaaatcccgaacacgaaaaattaccgccaaaggtataccccaataaatatagtgtatggaaaccgacatccagagaatctgtaaccttaactgcaatcgaggatggtttagccgcattatggaaaaagtatgaagaaacggttaaccatcgcgatcgcgcaatgacatttgggcgtttgtgggaaaaatttctcgccagcgcctattacagcgagcttagtcctagaactcaaaaagattatctgcaacatcaaaaaaagctgctggccgtattcggtaaggtgctggccgattctgtaaaaccagagcacatcagacgatacatggacaaaagaggcgagcagagtaaaacgcaggcaaaccatgaaaaaagcagtatgtcgcgcgtttatagttgggggtatgagcgaggatacgtgaaggctaacccatgtgcaggtgtaagtaaattcaaggccaaaaaccgcgaacgatatgtaaccgacaaagaataccaggcagtattaagcgttgcacctcttcctgtttttatcgcaatggaaattgcctatctgtgtgcagcgagggtttccgatgtgttatcgctgaaatgggagcagattggaaacgacgggatctttatccagcaagggaaaacagggaaaaaacagataaaagcatggagtccacgattacaggcggcgatcgaaaaagcaaaacagttaccaacatccgcctatgtaatcagcaatcaatacggcaaccgatatatgtacaaaggctttaacgaaatgtgggtagaagcaagaaatcacgcaggcaaaatttcaggtattttaaccgacttcacctttcatgatctgaaggcgaaaggaatttcagactatgaaggaagcagccgggataagcaacttttctctggtcacaaaaccgaagggcaagtgctaatctatgacaggaaggttaaagtttcaccaacacttgatgtcccgttacctgaaaatattccaagaaaatattccaagtaattccaagtgtgatttttgtcactgacttaatgatgtgtaagtgattgaattttggcggagagagggggatttgaacccccggtggagttgcccccactccggttttcgagaccg

SEQ ID NO: 117 - DNA  (genomic), 906 bp; double-stranded, linear
ttaaagatccttttgataacgtggttaaaaatctttcagtagtcttccgcacctcccccgcagacacgcaactgagtctgaacgcgcgtaatactaatgagaacggtattgccgaagttacccttaagggcacggttttgggtgttcatacagccgaagccatactgcttaacggcaacagagatacgaaaatcgtcaatattgcgcccgatgccagcaacgcgcaggtcaccctgaacatccctgcacaacaggtggtgacgaataacagtgacagcgtgcagctgacggcgacggtgaaagacccgtcgaatcatccggtggcgggaataacggtgaacttcaccatgccacaggacgtggcggcaaactttacccttgaaaataacggtattgccatcactcaggccaatggcgaagcgcatgtcaccctcaaaggcaaaaaagcgggcacgcatactgtgaccgccacgctgggtaacaataatgccagcgatgcgcaaccagtcaccttcgtggcggataaggacagcgcggttgtcgttctgcaaacatcgaaagcggaaatcattgggaatggcgtggatgagacgactctgacggcaacagtgaaagatccttttgataacgcagtaaaagatttacaggtcaccttcagtaccaaccccgcagatactcaacttagtcagagcaaaagcaatactaacgacagtggtgtggccgaagttacctttaagggcacggttttgggtgttcatacagccgaagccacactgcctaacggcaacaacgatacgaagatagtcaatattgcgcccgatgccagcaacgcgcaggttacgctgaacatccctgctcaacaggtggtgacgaataacagcgacagcgtgcagctgacggcgacgg

SEQ ID NO: 118 - DNA  (genomic), 2448 bp; double-stranded, linear
taagcgtacagcctgaaccgtctggtcagaatctgacgaattagacaaagtggtgtccaccaaataagtagtgggaaccaaagtatcagatatgcagaaaaatgtgactcccggcaggcgaaaaggctgccctaattatcctcccgaatttaaacagcagctcgttgctgcctcctgtgaacccgggatatccatctcaaaacttgctcttgaaaatggcattaacgcaaatctgttgttcaaatggcgacaacaatggcgcgagggaaagctgctattaccttcttcagagagcccccagctacttcctgtgactctcgatgcagctgccgaacagccagaatcgctcgcagaggacccggaaaccctcagtatcagctgtgaggtaacgttccggcacgggacgctccgcttcaatggcaatgtcagcgaaaagctcctgactctgctgatacaggaactgaagcgatgatcccgttaccttccgggaccaaaatttggctggttgccggtatcaccgatatgagaaatggcttcaacggcctggctgcgaaagtacaaacggcgctgaaagacgatcccatgtccggccatgttttcattttccggggccgcagcggcagtcaggttaaactgctgtggtccaccggtgacggactgtgcctcctgaccaaacggctggagcgtgggcgcttcgcctggccgtcagcccgtgatggcaaagtgttccttacgcaggcgcagctggcgatgctgctggaaggtatcgactggcgacagcctaagcggctgctgacctccctgaccatgctgtaaatctctttatcctggttgtcacagaataagcccggtaaaatacgggcttatgaacgacatctcttctgacgacatcttcctgctgaaacagcgcctggccgaacaggaagcgctgatccacgccctgcaggaaaagctgagcaaccgggagcgcgaaatagaccatctgcaggcgcagctggataaactccgccggatgaacttcggcagtcgttccgaaaaagtctcccgccgtatcgcacaaatggaagccgatctgaaccggcttcagaaagagagcgatacgctgactggtagggtgtatgacccggcagtacagcgtccgttgcgtcagacccgcacccgtaagccgttccctgaatcactaccccgtgacgaaaagcgactgttgcctgcggcgccgtgctgcccgaactgcggcggttcactgagctatctgggcgaggataccgccgaacagctggagttgatgcgtagcgccttccgggttatccggacggtacgggaaaaacatgcctgtactcagtgcgatgccatcgtgcaggcacctgcaccttcgcggcccatcgagcggggtatcgccggaccggggctgctggcccgcgtgctgacctcgaagtatgcagagcacaccccgctgtatcgccagtcagaaatatacggccggcaaggtgtgagctaggcgttcactgctgtcgggctgggtggatgcatgctgccggctgctgtctccgctggaagaggcgcttcatggctatgtcatgactgacggcaaactccatgccgatgataccccggtccaggtactgctgccgggtaataagaagacgaagaccgggcggttgtgggcgtatgttcgtgatgaccgcaatgcagggtcagcgttggcacctgcagtgtggttcgcttacagcccggacagaaaaggcatccatccgcagactcatcttgcctgcttcagcggtgtgctgcaagcggatgcgtacgccgggttcaacgagctgtatcgcaatggtgggataacggaagctgcctgctgggctcatgcccgccgaaagatccacgatgtgcacgtccgcatcccgtcagcactgacggaagaagccctggagcagatcggtcagttgtacgccatagaggcggatataaggggaatgccggcagagcagcggcttgctgaacgtcagcgaaaaacgaaaccgttgttgaaatccctggaaagctggttgcgtgaaaagatgaagaccctgtcgcgacactcagagttggcgaaggcgttcgcgtacgcacttaaccagtggccggcactgacgtactatgcgaacgatggctgggtggaaatcgacaacaacatcgctgaaaatgccctgcgggcggtcagtctgggtcgtaaaaacttcctgttcttcggctctgatcatggtggtgagcggggagcgctactgtacagcctgatcgggacgtgcaaactgaatgacgtggatccagaaagctaccttcgccatgtgcttggcgtcatagcagactggccggtcaaccgggtcagcgaactgcttccgtggcgcatagcactgccagctgaataacacatccccgtcaatacggccctcgctgtacgcttacgaacaacca

SEQ ID NO: 119 - DNA  (genomic), 3275 bp; double-stranded, linear
ggtgacaaacttgcatctggagttgtgaaagctgtttataattccgcaacagcaggctgggaagaatcaatcgcggtccaggggagcatcggtggatttgattatcgcatcaacggtagttattctgatcagggcaatcgtgatacgccggatggacgtctgccgaataccaactatcgtaacaatagtcagggtgtatggttgggttataactccggaaaccatcgttttggcctctcgcttgatcgctacagactcgcgacacaaacttactatgaggatccagacggaagttatgaggcatttagtgtcaaaatacctaaacttgaacgagagaaagttggggtattctatgacacagacgtggacggtgactatctaaaaaaaattcatttcgacgcgtatgagcagaccatccagcgccaatttgccaacgaagtaaaaacgacacagcctgttcccagtccgatgattcaggctctgaccgttcataacaagactgacacccatgataagcaatacactcaggcggtcacattgcagagtcacttttcgctgcctgctaataatgaacttgttaccggtgcacagtacaaacaagatagggtcagccaaaggtccggtggcatgacctcaagcaaatctctgaccggcttcattaataaggaaacacgaactcgctcctattatgagtcagagcaaagtacagtctcactattcgcacaaaatgactggcaattcgccgatcactggacatggacaatgggagttcgccaatactggctttcttcaaagttgacgcgtggtgacggagtatcatataccgcaggcattataagcgatacctctcttgccagagagtctgcgagtgatcacgaaatggtaacatctacaagcctgcgctattcaggtttcgataacctggagttacgcgctgcgttcgcgcaaggctacgtatttcccacactctcccagctttttatgcagacatctgcgggcggcagtgtcacatacggaaatcctgatcttaaggctgaacactccaataactttgaattaggtgcacgatataatggtaatcagtggctgattgacagcgcagtttactactcagaagctaaagattatattgcaagtctgatctgtgatggcagtatagtttgcaatggtaacaccaactcctcccgtagtagctactattattatgacaatattgatcgggcaaaaacatggggactggaaataagcgcggaatataatggctgggttttctcgccatatatcagtggcaatttaattcgtcggcaatatgaaacttcaacattaaaaacaactaatacaggtgaaccagcgataaacggacgtatagggctgaaacatactcttgtgatgggtcaggccaacataatctctgatgtttttattcgtgctgcctctagtgcaaaagatgacagtaacggtaccgaaacaaatgttccgggctgggccactctcaactttgcagtaaatacagaattcggtaacgaggatcagtaccggattaacctggcactcaataacctgacagacaaacgctaccgtacagcacatgaaactattcctgcagcaggttttaatgcagctataggttttgtatggaatttctgatgacaaaaacaatcgttatggaattctttgtcctgatctgcccgctttgcgggcaggctaacgaacgtattgtgtttgttgaaggtttttcgacgttgttttccatctgtgggtgaatatttattcttcccgccagcatgactctatactcattgctacgacaatgacttataaagctggttactgaacctatacctttgtaattcaaaagtgatatcagttcacaacgcaatactatttttagattatttactctcacccagatactgaatcaatggataataccttttgatttatcccgacgcggaagaaggtggtgaaccgccccggaaatcctggagactaaactccctgagaaagaggtaaacaggatgactaaaaatacacgtttttcccccgaggtccgtcaacgggcagttcgtatggttctggaaagtcagggcgaatatgactcacaatgggcggcaatttgttccattgccccaaagattggctgtacaccagagactctgcgtgtgtgggttcgtcagcatgagcgggataccgggagtggtgatggtggactcaccaccgctgaacgtcagcgtctgaaagagctggaacgtgaaaatcgtgaactgcgccgcagtaacgatatccttcgccaggcttccgcttattttgcgaaggcggagttcgaccgcctctggaaaaaatgatgccactgctggataagctgcgtgagcagtacggggtcggaccggtatgcagcgaactgcatattgccccgtcaacgtattaccattgtcagcaacagcgacatcatccggataaacgcagtgcccatgcgcagcacgatgactggctgaagaaagagatacagcgcgtatacgatgaaaatcatcaggtgtacggtgtgcgtaaagtctggcgccagttgttacgcgaaggtatcagggtggccagatgcactgtggcacgtctcatggcggttatgggacttgccggtgttctccggggtaaaaaggtccgcactaccgtcagccggaaagccgtttccgcaggcgaccgcgtaaaccgtcagttcgtggcagaacgtcctgaccagctgtgggtggctgattttacttacgtcagcacatggcagggcttcgtctatgtggcgttcatcattgatgtgtttgccggatgtatcgtggggtggcgagtctcatcgtctatggaaacgacattcgtgctggatgcactggagcaggcgttgtgggcccgtcggccgtccggcacaatccatcacagtgataaaggttctcagtatgtatcgctggcctacacgcagcggcttaaggaagccggattactggcatcaacagggagtactggcgactcgtatgacaacgcgatggctgagagcatcaatggtctttacaaagcggaggtaatacaccgtaagagctggaaaaaccggacagaagtggaactggccacactaacgtgggtggacaggtataacaatcgacgattgctggaaaggctgggccatattcctccggcagaagcagaaaaagcttattatgcttccatcggaaataatgatctggcagcctgagttcacagataaaatactctccaggaaacccggggcggttcag

SEQ ID NO: 120 - DNA  (genomic), 210 bp; double-stranded, linear
tcgaaactgttagcaaatataccattgcctgatgcgctccgcttattagtcctacaaaacatcaatatattgaatttaggcaacatttgtagaccagataaggcattcacgccgcatccggcaggaacaaagcccactttagttacagaacacaatgttcttgagggttttaatgacatattttcacgattacttttttaacctagtcac

SEQ ID NO: 121 - DNA  (genomic), 14187 bp; double-stranded, linear
accgctagatatgcggcttgaataacgtataaaaatgtatcagagtattataaatttcatgctgtatcagtaataactaagtaaaggatagcttaaaaagaagccataatttagtaaattagcgaaattatatatattttaaacattagtcccatttggaacgtgttttcgcattcccattaaatagatgttggcgatcttttcatttctcttgctggatttccgcacacagttataccggcaggaacacttttagtgacaacagcccccatacctataatggctcccgcgccaataataagtgggcgattaggaacaccctgcttaattactgcacccgagcctatatatgcattgtcttcaataacaacatatccattacatttagccccaggagcaaatgtaacatagtctcctatttgacaatcatgtgcaacgtatgagtatatgtttgcatgaaaaaacctccctatatgagtattagtagatattgtaacaaagggagaaataatagcgccactacctatcatagtatgatcataaacaacgctatttggatgttttatagttattggttcaaccccgtgtaataatattgactcagacactctctgtcgtatcttatcattagcaatagcaacattaaaatacttttttaaataaggggcttttagaaagcagttggttgaaagcacttcaaaaccattaactttctttcctgccaaaacatcatccacaaaaaccagagcatagtcagaaccacattcttgctttatttgttgatttagaatgggtattgtttctctaccataacttccagcaccaaaaataccatacaaattcattttcccatctccaaagaaatatcttatcaaaaccaatgcaagattatgaaagcccgcacgctgcaatgcctgacgctaggaagtttctgtccatgactgcttttcgcatcttacatgataatcctgccttgaatacattatcattgtcagatattaatagcgatgtgccgcattctagaaaatcattcgaatgcaactcgccttcttatattatagtcgatttcattcattaccacatcaggctactgtgcaacttattctccatgcgccagtgatttcgatttactgtggcgaacttctctgcggttaaagcagcagatctaatataatatttgatcgtcatttcggattctttcttttgctctgctattattgagagaaagtggactgccattcataaattctgcagccctttccattcaaacgtgaaatcaataagctcatcaggagcatctcaaacaatatgaagacggacatcgtctctgccgtgcctcttttcactaattgcgtaactgtcatgttttggattatttaattctttcagcgtaaatatctcctcaaagactctattaagccgactcttatttccttttacagcgaataaataatcacatctctgtttttatatcttctctgcaatatctttctggcaagccatcgcatcagttatgattatttttcctttaatacccatcattttagaaagttcatgaataactgtgaacgcattaggtttctcatccgtcttgatctatccgaggaccagactgtgcattgctgaaacgcactaatgacatgaaccactcctctgcgacgactcttgtcataagtgtgccgaagtgttttaccatcaattgcgatgacgtcgttatcatctggaaaatggcagacatgtattcagttaacaaagcactcgtgaaatattgcaggactgatgcaggatacaactttggctataatatcgtaaacagggataataaaaatctattgtctcaattattttaagttccattttgttctcctttttatataaggcacatttgttattacataagcgatgaaaaaatgtcttaagcaaaggaacgtctcaatcgtgacgtgaaatgcaaattggtcagtacaaaactttatttctattaatcttttcctagataaagttgcggtatagtcgttatacataaaaaagcccacatattcatcatataccgcaataacattactttaatataatcttaaatacgcttaatgattaatgtaaataatcactcacttagcaatttaagaagagctttagttttcttttccattagctttacatcaccgcgtgattccacattcaaccgcaccaccggttcggtgttggaggagcgcaggttaaagcgccagtcggcaaaggtcatgctgatgccatcggtgcgatccaccgccagcgcctcgcggctaaaatgctgttccacgcgattaattgcctcaacgggttgcgccagtttgctgttgatctcaccgcttgccggaaacgccgccatccggtcgcgcaccatttcgcccagcgtttttcctttcaggcacaccagttcggcgaccagcagccacgggatcatgccgctgtcgcagtaagcgaaatcacggaagtaatggtgagcgctcatttcgccaccgtagatggcgtcttccttgcgcatacgttctttaataaaggcgtgtccggttttcgacattaccggggtgccgcctgcggcagtcaccacatcaacggtgttccaggagagacgtggatcgtggatgatcttcgcgccgggatttttttcgaggaacgcttctgccagcaggccgacaatgtagtagccctcgataaactgccctttttcgtcaaacaggaaacagcggtcaaaatcgccatcaaaggcaatgcccatatccgcgccgtgtttgatgaccgcattacgggtgtcgtcgcggcattccggcagcagcgggttaggaataccgttggggaaattgccgtccggcgtgttgtgtactttgattaattccaccggtgcgccgagggctttaaatcgggcttcaatggcgtccaccaccggacccgctgcgccgttcccggagttgatcaccagcttgagcggcgtgaggtttttgacgttgatataaccgaacaggtgatcaacgtaagcgtcacgcagattgatttgctgatagcgaccacgtttggtttcatcgacaggagggaagtcattggcttctgccagacgctggacatcgcgcagtccggtatcaccgctgatcgggcgagccccttcgcgcaccagcttcatgccgttgtaatccatcgggttatggctggcggtaacttcgatgccgccatccactccgagatggaacgtggcgaaatagatctcttcggtgccggacataccgatatccagcacatcgacgcccgcatcctgtaaacctttcgcaagcgccagttttaacgcttcgctggtgaggcggacatcaccgcctaaaacaatggttttcggtttgagaaattcgccataggcacgcccaatgcgccaggcaatatcttcattcagttcttcgcctaatttcccgcgaatatcataggctttaaagcaggttaaagatttcatatgttaatcttcatgtttgtaacgttctttctgtcttataatatcatcctctcccaaataatcccctgaactgacttcaataagattaagagggattatgcccggattctcaagactatacgctgcgccaaggggaatgtatatcgattcatttgcggtgactagtttagttttatcgccaagggttacttttgctgtaccagaaagcacgatccaatgttcagaacgatggtgatgcatccttaaagaaagcccctcaccaggtttcacaataattttcttgactttgtatcgctcaccttggtcaatcgaatcaaattttccccatggtcggaaaacttcacgatgactaatatactctgtacgttgctgcaatttaagcatttcgactattttttttacatgctgtacatcactctttttagacacaagaacggcatctttagtttgcacgataaccatatcttcaattccaatggcggctaccaacgctgactcagagtagatataattattcttagtatcataggttaatatatcacctttacatacatctcctgttttcgattttagactaatgtcccataacgattgccaagatccaacgtcactccaaccaatatcaacagggcatacaacacatttttctgttttttccattacagcaaaatcaatagattcagcaggacaatcttgaaattgttcttttgataatcgaataaaatctagatcaatgtatgaggatgaggcaacctgttcacaaacattgtaaatgtcaggtctaaattttctcaattcctcaagataaacagatgccttaaacatgaatattccactattccaatagtgattaccagaagtcatatacaattctgcggtttcacgattaggcttttcgacaaacttatttacataataaaaaccagtattttcatgcccttgaagcggtacagatagttcacctctctcaatatacccataaccagtttcagcatattctggtataattccaaacgttacaattttaccttgattagcgatgggagttgcatttttaatagcatcacagaaaacactttctttagctataacgtggtctgccgcaagaactagaagcaatggatcttcctgaggattacgttttaacgcatgaaacgcagatatcgctattgctggtgcagtatttcgcccgcatggttctagaataatattaccatttaatttatttatttcccttaactgttcagccacaacaaagcgatgctgttcatttgttatcactaatggtttttgacatgataggcctgaaagtcgtagcaaagtcgtttgtaacaaggtgttatcaccagagagttgtaaaaactgctttggatatagttcacgagaaagtggccaaagacgactgcctgtaccaccggccataactacagcaattattggcgcatcagacatattatatccttattatctaagccaatcgcatcatttgttttattgttaaaatatgcgcgacaattataatgcacatcgtcatcatttatcagctttgctcgcgatagccagcaataagcattatgttgtgacttcggtaatttcaaaatgtttggttgtaatttaagaaggaatgctataactatataatgcgttgaaaagtctccccccatactattgtcttcgtagaagtgctgccagataccataaaacttacccacagagagaggcaaacgaattcctagttcaatttctgtcaatcgttcaaaggctgtctgcaatttttcatctttcaacaccctaccaccaggaacgaaccaatagccctgtgccgggcggttgattcgttttcctagcaaaatttcgccaaactcgttttccacaatcaaatctatagaaataagaggagtagaccttacaattgtggcaaagtcttgggaatgtaaaaacattattacccccgatattgaagttggttttcaagaaaccagttgtatgtattttcaagacccttgtgaagggtaattttatgattccaacctagttgatgaagaagcgttacatcaagtagttttcgaggggctccatcgggctttgttgtatcgaacgtaatatgccctttataacctacaacttttgctattgtttccgcaagctcacaaatcgtgcagtcaatacctgttccaatattgatatgagacaacattactttagtatttttttgccatatatcgtatggcatctccatgacataaatgcttgcagaagccatatcatctacatgtaagaattcacgctttggagtaccacttccccaaacaacaacattcggagaattgttttccacagcatcatgaaagcggcgcaaaagcgccggaatcacatgagaattacttggatgaaaattgtcatttggaccataaagattggttggcattactgaacggtaatcacgcccaaactgacggttataagattcacataatttaatacctgcaatttttgcgatagcataaggttcatttgttggctcaagtttcccttgtaataattcgtcttccataatcggttggtgtgctaacttaggataaatacacgacgaaccgaggaaaagcagtttatttacattatttttgtgggcagcatgaatgacattcgcctctatcattatattctcatatataaaatcggcaggataagaactgttagctaaaatacctccgacttttgctgctgccaaataaacctggtcgattttctgtgaagaaaaaaaatccaaaacagcgctactatccaacaagttcaattcatcccgagtacgtaaaaccaactcaacatcatcacgttgtttgaggcgtcgggtaatagctgatccaaccattccttggtgaccagcaataaaaatacgttgcttattcatcatcattccagagctaagcttacagaaaaaccatgcgattttaaaagagaatgttttttagcggcttcaagatctttggcaaccatttcagaaatcatttcagcaagagtaatttctggtctccaaccaagtttgagattagctttgctcggatctccaagcaaagtatcaacttcagctggtcggaaataacgaggatcaacagcaacaatgacatcacctggtttcacacctggagcatcctgtccttcaaccgaatctacaatgcctttttcttcgattcctttaccaacaaagctcatcttaataccaagttgtgctgctgccatttcgacaaactgacggactgagtattggactcctgttgcaatcacaaaatcttcgggttgctcctgttgtaacatcaaccattgcattctaacataatcttttgcatgtccccaatctcgtaacgaatccatattccctaaatacaaacatgattccaagccttgtgcaatatttgcaagtcctcgagtaattttccttgttacaaacgtttctccacggcgtggagattcatgattgaacaatataccattacatgcataaataccatatgactctcgataatttaccgtgatccaatatgcgtaaagttttgcaactgcataaggggaacgaggataaaaaggggtggattctttttgagggatttcctgaacaagtccatataattctgaggttgaagcttgatagaaacgcgttttgttttccaatcctaaaaagcgaattgcttccagtaaacgtaatgtaccaattgcatcgacatcggctgtatattctggagactcaaaagaaactgctacgtgactcatagcagctaaattatatacttcatctggctgtacctcctttagaattctagtgaggttagatgaatcagtcagatctccatagtgcaagtgaaaatttgggttagaaccatgtggatcttgataaatatggtctatgcgttctgtattaaaagatgaggctcggcgtttgataccatgaacttcataccctttatcaagcaaaaactcagctagataagatccatcttgtccagttacacctgtaataagagcgactttagtcattatatacctcttgaatatattaagatcgggattcaatttcttgtttcacaacatctaaaagaaaatctgcacacgcattgcgtcttttgagacccaattctatcagagttgtaggttcataaaaaattttagattcatcagcttttaccatcgcgtcatttaatgaataatggttttttgcctgaaagaaatatacatcaccgcaattaacttctttattgacatctatgtcagatagtataacttttttccctaatgcaatagcgtcaaatgttaccccccctccaggcccgccttcaaataaggttggttgtattacagcaatgcaatttttgattaattcaatttgttcaagtttaggtatatgccctaatatcttaattttcgattcaattccgagcttttttgccaaaaccatcaattcattaaaatatccagggaatcgataatcttgagtagctcccgtgcatactaaataaacatcaggattatattcagtataaattttaaatgccctaaaagcagttgcatgatctttatgtttccaaaattgattgcaaattataaaataatccttgtcaatattatatttggcaatattaccagagtaatcagcgaaccattttaattgagggcatggactaaatggaagagaatgtagttttgcagaataattcccaacatatttatttgcatcggtaataactgaatgtgcattaacaataatattgttagcgcaattgagcatcaatttaaaaaacacattcctttgatctatttctcgcttactaaaaaatgaaggatagtaacagtgttgaaagtcataaatataaccaatccatgcttttttattcaaatttcccgaaggaacacgcatgcaaggaagaataacatcacaatcgctactatcaaaatatgaataaaaggcagagctcttacttttaataaaggtaagattcgtctctatattattttgtgtaaaggcatctctatagtattgctcattaaatctatttaatgaaatccatcgaggcctttccctctttaaaattgcttttaatatacttttaaaaggaaatgctttttctcttataagagaatgtatatcatttctcggtaaaagaatatcgatacatatttctggtttcgtttctaatattgacagaatatatttaataaaatcaattccaccgccccactcgtaaaatccatctgaattcaacgcaattttcatgaatgacctttacaatattttaggctatttatcactataaaattcgttaatagattcacaaatataaataacttgctcattcgataggctggggaaactaggtaaattaattccacgccaaccaagatcctcagctatagggtgcttttgatatttttccgagtacattggcatcgtgtggacagggtaaaaaactggccttgtttcgatgagtttatctgcaaggtgattccttaattcctctctttcctctgcggtcctagttagaattgagaccatccaataagtgtgaaaaacatctttactttccttgtggacttgtacaagactgttgatattttttttataaatatcagcaatttcacgttttcgtgatataaaatcatcagcttgttctaactgggctaatcctatagcagcgcagatatttgtcatcctataattgtagcctataacgtcatgccaatattgcctatgtacagctaatccttggcctttaaaatgtaaacaacggtcataaagtgttttgtcattcgtgacaaccattccaccttcacctgtagtaatagttttatttccaaaaaagctaaaagtagaaatatctccaaatgttcccacatatttacctttatatttagaaccaaaggcttcagcgcaatcttcaattacaaacaaatttctacttttggccagttctacaatttgttccatatcacatggatgtccgtataaatggacacacataatagctttagttttattagtgattttttgttctatgtcactaacagacatttgccaagtttcattatctgaatcaacgaaaatgggggtggctcctgtgtattttatagcattaactgatgctatatatgtcagtgttggaacaataacttcatctccttccgatatacctaacgctaacaaagctaaatgaagagcaaccgttccattacttacagtagttgcatattgcacatggttttgttccgcaaatttattttcaaacttctgaatatagtttccttttgatgaaatccacgttgagtccagacattcatttacatattctttttcttttcctgtcaatgacggttggtaaactggtatatatttcattttcatcctcttatatttaactgtctatcgatatgttttttaaaactacatttataccatataaagtaatttacaatatatataaaaatgaagcagtacaacataacagttaacccaaaatggctaactatgatgtattttgctggaattgcgatcaatatcaatgttacaacagcaagcatttgttgtttaactatgttcaaaccatttaaaaagcttgcaaatgtattcgaaaaagcatcaataacagaccataaagcataagctattatgaatgttcgaggtacctgaatctttccttctgtccaaatattaacgacttcactaccgaacactactaatatgaaggccaataagaatgatgaaatacccactattttcaatgatgttctgagcgtcttttttataaattgagtatcattgcgtgcatgagcatctgcataagcagcccataacgggatgttataaatcgtaagagggaccgtagatatttgaaataatctctgtgtaatgctaaaaacagcaacataagtaacacccaatgttatagatattataaagttatcaccactccatgttgccagagtgcctaactgtaaaataaaaaagaaaaaaccgtttaatatcaaatatggagcttctcttttagcatgtatgttaacttttgtaaactttattaatcgctttataataagattaattgttaaatagattcccgatatgtattgaataccaagagtgctgacaattaaaactggtagtcccgcatgtagtttcgacgatattactagagtaataatagataacaatataaatatggcattaacaatattacttatataggctttttgtattcccatataaactttttgcacaccatttgaataaattccaagtccaaatatgattacaaagactttaattgagtgttgtaactctgcatacacattctcgtttataccttttattactagttgccaatcaatcatgccagaagtaatatagcatattgcagttatgacaaacgataatccagccagcaaagtgagcccaccactaatttgccgactcatctttaaatttttgccacacgcaaatgaatgtgcgatcctgtttgttaatgcatttcctatacctaagtccaaaaatgtcagagcagcaccaagactggtaatagtcatccatacaccaaatctctcttgtcctaaataaggtaaagttaaacttacagttaatataagagaaagtagtgagagtattttactaatcaaacttgaaataacagacaaggatataatcctgtacctttcctgttctctacctaaagcacttgatgtatcatatttttttaaagtgcaaaatttaagtatttttttgattttattcattatcatatggtgaactattcttcatgaagaataaagttagacaaatatattgcattttccgcaatactcttcttaaacgttcagggaataaaattttgattattgaaattggaataaacttaataaggttttttttatttttttcaaacataattttggcaagctctttatctcttaaaattcttttttttgaagatactccccccatatcatattttacataacccgaagtaatcaaagatagagatcttaacccttcaggaaacacctcttgaataagcttataatcagcacatattttataccttagatcatattctgaatgattctttgggaaaatcaccccttgatgacaataccctgtatttgaatgggttatagaagaaaatcccagaagtttatcattttcgaaaaggccaactttaatcaaacatggctctttgatatttttatatatatctccaattacgctatcgccggcgtttaaataatgtattaagtcgcctttggccaacattcggcccttattcatcgcatcatatatcccttcatctttttcataaacatgtgtaatattcatactagtaaatctactaatgacacgattcgttccatctgtagagccgccatcaactataataatctcaaaaggttttatttttaaaattgataaactacttaaagttttttctaacccttcagcattattataagtcacagttataactgatattttcatttcgtgataatctctttaacgtatcatgcaataagatcagaggagtacacattatcaatacggagagaaaaggaccaaaaaagaaggccgatgcattcccagccactaagtattgcaataaaatcataatgatatatgaatagaatgcgcaatttatcgagctatgggtttttttcattctctttaaaagataaaaaggtatatatatccctaaagggataatgaatacacagagaaaaccaaaaaaaactaacagttctgctccatacgtagtaactgataaaaaatttgctcccatgtctccaaatacttgtttatgtaaccgttctccataaaataagtcttgatgctttattccctgtattctatttattattgcttttaattccttttctaactctggtgtcggaaagaaatcgttcttaatagattcagaaacaacatatggaacactttcaacttgctctattgttaacctattaattatccttaacatattattatatgagtcattttgttctccgtcttgtcctaaacttagataaaacaacgagcatacaacccctaccaataaaaaataccctattattctttttattttaggattacggttatcctttgacaggatattggtaatcaatatatattgaagaatgagcaacaccaattcagaacgataaccaaataaagcaatcgttgtaaaatatacaaatatgatggtcctctgtttgaatttatgctcatcataaagaataattaatgcaaacacaactatattaccaaaatacttaatatatctaatgtaaagtccattaccttcagctattctaagtttagccccccctggatcatcatcaaatataggaataccttctttaagaaataaaactacagcagcaatttctatagtcacaaaaaggaaaacgagtattaactttagctcccagttcacgataaattttttctgctgttttctttcatttataatcgttagataaaataataaaacaaaaaaaatctgaaatataattataatactagttaatacctttgtatcaaaatttgttatacgatcatctatgataaccccatacaactggagactataaagtgtaaataggaataaaaaaatcaacttagccgctgacttcactttttagtctcctttctccttaatagtgaatgtgttatttttttcatgactccatttgaagcatataataaaaaataatataatgtttttggaaaggacaaatgtaaatgttctctatatatactccatgtccattttgcagctttaattttattacccgatagtgaattatttgaacgcatgtaatacgccagattatcttgaatacaaatagcaccatttgttttattaattatttccagccacatcaaataatcctcgtgaccaatctttttttgataaaacttacccaatttgttggcattatagattcctgtcaaattccctatgtagtttttcatgagcatttttctataatttatcacatgaggagcattaacttcgccaacaatatttcttttgttatctataacataataattagaacataccacatctacacattcattatttaacacttcgatttgacgctctaattttttctcgtgccacaaatcatccgcatcacaaaaagaaatatatttccccgtggccatttctattccataatttcgactttctgcaacacctaaatttgtcttgttacgcaatattcttattttctgattgtttttgtatcgactgttgattaatgaaaatgtatcatcggtgctacaatcgtcaatgatatacaaaacaaaatcttgataagattgatgtataattgattctactgatgagattatagttttggccccattgtaaacgggcataattattgaaacggtttctttgttcatttgagaatttcttatatatttttaatgctaatagttttgataagcattaaaatttatgcacgctaccgcccctggcttaatcgctaccagtgtacgaaatgataatccatgttaaaaaaatcatctccaagcgtttattatcttattattcagagggagaaacaagactaccaaacaaaaaatacatatctgcacactatttattcattggtagcatagttaattataaaagctcaacagcagtgatatttattgatctatagtt

SEQ ID NO: 122 - DNA  (genomic), 1376 bp; double-stranded, linear
cctacctctaagtggctgatagtgcgtaaattattgccataggttagccaaacgttatggctatataccaaagcttagttccgcataactttgattaaaccttacgataacactacacaccatcagcatctgggttactcggattactcggaaatccacatactgataatttaatcagtacctctttccgaataatcgtagtccaacctggtccttttttctctgactcgtctgcattactcagaaacaaacgttatgtcgtcttttttggcatggacgaattcatactgcagagttcgatccagaccttgcgacagcgtatacggtgccacaaaacctgaagaatgcactttcgttgcgtcaaactgtgttgttgcgcagaattttttcacgcgcacagagctgacagcgtattttttgcccgtaattttgctcaggatatcaaagcaatatccacccagcattcctagtgggtaaggcaagtgcatagaagggatctttttgttcaggctttgttcaacttcagcaaccaactggttcatgttcaggtctggcttatcaacgtagttataaacctcgtaacctgcggcaacattcttcagtttgtacttgataaactcaacaatgtttccaacataagccatggacttatagttagtccctgcgcccaccatcataaacttgccgccagcgatctgtttcagcaagttatagacgttaccgcggttgcgttcaccgaagataacggtaggacggatgatagttaatgaacgttctgttggtgctttgttataccattcacgcagcacttcctccgcctgccacttgcttttgccgtagtggttgaaagggtcgtgtggatggttttcgtcagggttgtgtttgttcaaaccataaacagcaacggaactggtaaagatgatatttttaacgccatttttttccatggccgccagcacattgcgggtaccctgaacgttgacatcataatagagagaagtagggctgacgtcatcgcggtgttccgctgccagtagtacaacagtgtcaaaaccggctaacgcctggtcgagtgcctgttgatcacgaacatcaccaatctgtgtgatttctggataaaagtggctctgctgtttgtccaggttcttgatattaaagtcagcaattgccgtttcaagtagtcgggttcctacgaatccggaagctcctatgagcaaaacgttatcgttcataaatcactttagtctggttgttacgtaagaaacacaagataaagatgagtaccttccctgagtagtcaatgctgcccagccccagctttaacagttagtgtgaggattataatcttttagaacattatatccagtaagtttatg

SEQ ID NO: 123 - DNA  (genomic), 88 bp; double-stranded, linear
tgccgcgtcttatcaggcctacaaaaccgaaccgtaggtcggataaggcgttcacgccgcatccgacaatcagcgcctgatgcgacgt

SEQ ID NO: 124 - DNA  (genomic), 745 bp; double-stranded, linear
aaacatcaaatgcgcaggttcaaactgcgcatttgatttatacaaaatttagtataatctaaggatggagtaatgagaaaaaagctggcttttcttgataccagtcttgacgatttacgcgcatttccagaatcgtctcgacaggaaattggctatcaactcgacaggatccaacaagggttaaacccatacgactggaaacctttttcaactatcggccctggtgtgcgagagattcgtactcgcgatgctgatgggatctatcgcgtcatgtatgtcgcaaaatttgaagaagcggtttacgtattgcattgttttcaaaagaaaacacagactaccagtcaatcggatattgatttagccaaacgacgctataaagaacttgttcaggagcggaaaaatgaaaattgaaacctttgatagtgtgtgggatgcggtgagtgacacccctgaacaagcggaaaatatgcggatccgtgccgagcttgtaacgatcattaataactggattgaacaacaagggtttagccaggctcaggcagcttctgctttaggggtcactcaacctcgcatctctgaacttgccagaggtaaaatccagatctttagtatcgataaattgatcaccatgatggctcatgcaggactacatattcaacgtattgaagttcaatatccacatgctgcttagtgctataaatacagatggcgacaaattgatgccgccatctatataacttgtctt

SEQ ID NO: 125 - DNA  (genomic), 328 bp; double-stranded, linear
ttcctcgggaggggctttcccgtttcagcatcccgctgaaatcgtcggcttacctcctttcgccatgcatgcagtctatcgctgacttgcggataaaatagtttccagtgtgattattgcgtaacgtctcgcaaagaatatttgctggcaggatcgcagactgcaaagcctgcagattgacaatcttatcgtgaaggcatactttcaggagtgagggtagagcggggtttcccccgccctggtagtcttagtaagccgggaagcttatgactaagagcaccacgatgatgatccacttcatcatgaccctttccttatttaaggcccc

SEQ ID NO: 126 - DNA  (genomic), 2272 bp; double-stranded, linear
atctctatattttgtgccagcttaggggaagaggcttgcagatgcaagctcgcctccattcattacgtcttcactgtgtaccccatatcagtaatgaaaaagaaacaattcacacccatcattcaggtggtaaaaactgtagactatcttaattagctaatttatattatttatctaaatttgataggtgagataaaaatgacagaaacccagatctacgagaacattaagcaagccattagcagcgcaccacgaaatagccaaacgatggaaatgcacctccagatgatcaaatacgctgaccatctgaaaaacgtcacggcaaaagagttttgcgaaggtgtaggacttaaagccagctttgctacagagttcagcaaaatgagaaatcttaccgagcgactcaaagccgccggacttgataccacgaagttataacaaacgaaatcatcaatatattactttcgttttccagggttccctgtatatgtacctatgatcataaaaaccagttaccaccacgtagctgataccataatattttcatttttactttaaataaatagataaatttagagagtggaataattaaggtctattttctctagctttttgagattgatagttgagaatgataattctttcatctcaataacaccgaagtttgatagctgtttaagccacagttgaagaccagcatcagagcaacctgctcgatatgttacatcactacattttattagtgttgatttcctcttatagagataaataaggacttcatagatgcgttttccggtgtcattggatacgcgctatacccccattcttggctaaatcttggttcataatcatactttaattaaaatggatctaaaaattcatcatagatggctggatttttcatagaaaaatatgtttgaacaccatttgatatttttatttattgatcacaggctaacgttcttgaatattctataaatgatgcttcctctattctaactctacccacgcaatatatatacaaccctacctatactcgaagtacgttcaacacataagacaacgaaaagtagttgtgtgctgtaaaatttaaatattttaataattaatttcaagagcatgctgtgccccctatattatgcaaatgaaaagtaggaaaaaatcataagacacattaaacgattacaataatcaaacctatattaaggtgaatagaaggtattcgaatgagtcatttctaatatttttagtcttacgggcaaaggctatctattacctaacatgcaatggaaagcggaaaagtatgtagatagtgcaacttgttccctgaactgctgtttatccaacctattgctatgaaaatacgtaataatttcaaacctaaacaataccattgctaaacaaatgaaaacttgttcgttttactaattaatagttttataatgactaccccaaaataggtaacccaaatccaagcaaagggaaaatatgaagagtaaaatttttgctgcacttctgctactacctctatctacttatgcaagctcctataaatgtgatgctcttcagcagggtcaaattggcagcaatgggaaaaccgttacggcacaatcctccatcgatattgacggcaaacagatgcattttagcttgaacggagtgagttgggatctctcatatattggtgaaaaacagattgcaaagatgtatagcaccgaaagcgggaacgtctctgtatctttcattgatgccaatcccatcatcttcgtgctacatctcgtaaacgatgatggtagaaaaggcacttacaacatcagtgaatgttctgaattataagaggctaaaatgaaaaaactactcgttaccgtcatctttgtggcaatgatgccaaatgcattcgcactaagtcacggagacagcgcaacacttaaagaaggtacatttaactgtaaaaagttaactgacttttacgagatgatcagttacatccaggacaatgaccaacaggctatgctgagtctcattacatccaataaatgtcgcgtgttagatgaatcaatgacggtagaaatccagagcgtagatgacaaaggttttgtttcattcataactccaggtggtcatggtggctgggctgtgaagcaatttttcgaaaattaatcaaactataacctcgaatggcgtgtgtcctcacgccatttactctaattcagcttaacgtcacttgtccctctatttattgcctcaactacggccatattaggcactttca

SEQ ID NO: 127 - DNA  (genomic), 30 bp; double-stranded, linear
atcaccatcatgaacatggcgacaacgaag

SEQ ID NO: 128 - DNA  (genomic), 958 bp; double-stranded, linear
atgactggtatattaataatgttgctatttaatgaaactcctggtttatctgttttccataatgatgtcgccgcgccctgatcgccgttggccgaaattttaatggcagcctcagtcccttttggtggttctgttagatccaacacaaaccctacaccattatctgttttaccacgcaaaatagtattacttcctttaactaagtcactgctagaaagatatacaaccatattccgcgatgcttgttttttgtcgccgaaaagattatcacatttcaacgtaattgttccttccttactgttcgccgcaatctttccctgatttctgagctggaacaaggcgatatcatctacttttataacggtgttttcaggcttacaggtcgtatttttaggataataggaaatatttaacccaagcgtaaatgtatcccccgccagtttgctggtgagataattcacacaccagttaaacttcaatgccttacaaatacccaaccaaaaatcgatggatgacgatgactcaccgccaatatttgcaatcacggtatctgaaataaaccaggtagattttctttctccagtaaaatcaggtgtgcctctggctattttaaccacataaggtaatactgcctgcgcattgctggatttcccaattgtgtcgctggttttacctaaagactctattttaacctttaatttttcgccattaccaaaaggcccaacttcaacccaatcactttggatatttttataaactattttatccgtgctcgtatcacaagatatcccagtaaacacgacacttttactaaaggaagtttcattcgctaaaatctccccaacattaataccatctgtaatatttaatgatgcagtagtacgacacccagcccaggtaaaattagcccacaatataaatattagtaatattctatttctgaacatcatatttcacc

SEQ ID NO: 129 - DNA  (genomic), 69 bp; double-stranded, linear
atgctggccgccatgaatatggcggccattttaacttactgaaaaaacaagatgattattttaaatatt

SEQ ID NO: 130 - DNA  (genomic), 26 bp; double-stranded, linear
gctataacaaacatttttgaaactga

SEQ ID NO: 131 - DNA  (genomic), 30 bp; double-stranded, linear
cacgatagttggtttcaactcgttgtaaca

SEQ ID NO: 132 - DNA  (genomic), 3823 bp; double-stranded, linear
aactgaagcttatcgcggagaaaacgaaaaaaggctatgtggaaaatgcttcagcaaacgtgcatatcccccccatcaccaaagccactcctgaagttgaaacttcccctgagagtaaaaaccaacgcccgtggctggctgatgatgcagttattccggtaactgacgatattaaccgatttgcttttcctcatcgctctcgccccagagagatcaattatctgcgcaaagacggtgagatatggaagcgtattgcagataacaccagggcatatgatcccgacaacaattaccgctcttatcctgaaaactggcagcaggcttttgctgagttacaaaggcgaattctggataatcaacagacagggagtgcgcaatctgatgcagcattgctctggagtttttggaactcttactctgcagatgaactggtcgatgacttagtcattcgctgtggtctggaaagcgccgttgaaatcgtcctttttgcccttcaactcaaatataaaccagtaaaaggcgcagtaaccaccatcattccacctaatcacgaagcagaatcgctacctagttagcatcaacgtctatgtcatcatctttcactcgcttcagaagatgagtggcaacgctgtgtagataaagtactcaccgccattccgacgctatcccccgcacggcaaccttttgcggcgttactgctccctgaacgcccggatatcgcccatgctatagatctacgctatgcagaccaaaacgtcccggcgatgacctggttaagactggtgataaccgatgatactgctctgagtacagtggaaaaatacgacttcccaccgttgtatcgtgattttcgtaattttcgcgcttatctggcaatgttgttggcaaataatggggtgcgcggtgtaagccggatacttcttgagtttacggaagaccattctgacaatcccacttatctcttcgaacgcatcagcgagactgaaaatcttgtcaaatggctatggaaaacgaatcacccggatgcgattcaaattctgatcctcggtgtaattggtaagaaaaagcacctggaatacttaagcaaggccagtcaaaagcatcccgctgcggctattgcggcttatgctactttgctggcaatacatgaagataaagagtggcgtaaagcgcttgtcaaactgattaccgccacgccagagttagtatgcgacgtcattccctgggttaatgctaaagcggcaggcatcttatctgaatgtcgtccgcagtcagtcgctgaagaatgtgaatatgccactgtggatatgttgccggagctgcttgtttcgccgccctggatgaccaaagagaaaaagaaaaatacgcctgtgtttgatcttccagtgcttccagttccttctgtttctgatgtcactccagagattaccaaaaaactgacccgtacttaccttgtcacccacttccagcaaatagcccaacagcaggcgacaaaacaaacattgtttaccgacctgccgccgatcaaaaaagcaagctgggagaaacacttaataccgcttacaccggagcaacaaatactgtggcatcttggttttgaaaaatggcgggagagcggagaaaaaatatacgaaaaaattccggcgccacaaagcgccgttgatgccctgctacgcttcgattttccagcactcaatgctgaatttgtgcattatcataacaatgcatacaaaagctggaatctcattgccctctgttacctgcctggtcaacaggccatttcttttcttaaccagatagtcaaagaagataactactctggtgagggaaatattctggcaatttttggtagcgccgccatacctgcatttatggcctgcctgcaacgtgatccacgacgtctgtgcttcttcccctttttcctcggtgtcagtgaactggccttaccgatggcgcaacaattacagaaaaaaatgtcttatgaagatgcgcgaaactggctaactgattatccacgccatgccgccgccgggctgcttcctgtggccctgggcaaaaaaggaaaagatcgtgattgtgcccgccaggcgcttcgtctgctggtgaatttaaaccagcgagaaacgattgaggaaatcgcgcaaggatataatcaacctgatgttttagctgcgctggcaacattgttcgatagcgacccactggaagaatatcccgctaaaatcgccccactgcccggcttttatcagttcaccttgtggcgcagaccacggcttaaaagtaacaacctgcctctgtcagatgacgctatgcgccacctcggcactatgctgagctttcctcgcgacattaccgcctacgctgggctggatatcattagagaaatcttcacccgcgaatcactggctgaatttggctgggatctgtatcccgcctggacagaagctggcgcacccgcaaaagaaaactgggcatttacttcgcttgggattttaggcaatgacgacaccgcgcgtaaattaaccccgcttatccgcgcctggcctggggaatcccagcataaacgggcggtgtccgggctggatgtattagctgatattggcagcgatgttgcgctaatgctgcttaatggcatcgcgcgaaaaattaaattcaaagcattacaggaacatgcccgcgagaaaatcaacatagttgctgaaaaccgtgggctgactatggctgaactggaagaccgcctggctccagatttagggcttgatagcagtggctcgctgatactggatttcggcccccgcaaattcaccgttggttttgacgaaaccttaaaacctgtagtgtgcgatgcaaacggcaaagtcctgaaagatttacctaagccaaaccagagcgatgaaaaaactcaggcaactgacgcggttaatctcttcaaacagttgaaaaaagatgtacgcgccatagccagccagcagattgatcgtctggaacaggctatgtgccagcgcagacgctggacggcagagcagttccgcctgtttctggtggagcatccgctggtacgtcacttaacccgacggctgttatggggggtttataacgatgaaaacgcccttatcacctgttttcgcgtggcagaagacagcacttacagcgatgcgcaggatgagttattcacgctgccagcaggaaacatcggtattccgcatgtgctggaaatatcccctgaatccgccgctgcattcaggcaaatttacgctgattacgaactgcttccccctttccaacagctcgagcgaggtagctatcaccttgctgataatgaacgtaatactcacgaactgacacgctggcaaggacggctttgccaggccggacgcattgtcgggctggaacgcagaggctggcaacgtctggaagaaagcggcagcgtttatgcgatgcgcaaaacaacccctcatggcgatctcgaacttgaaacggaacctttttcattaatttatggtgaaacggggtatggcgaccagcacccggttgaaagcgtaaaaatcacctcgccagatgatcgctacggtaaacaatcctcactcactttctccatgctcgacgacatcaccgccagcgagctgattaacgacattgaatcactgtttgattaaaaggatttaacaatgaaaacctatatttatcaggacgaaaaatcacataaattctgggcggtggagcagcagggaaacgagctgcatattaactggggtaaagtcggtaccaacgggcaaagtcaggtaaaaagctttgcagatactgcggcggcggaaaaagcagc

SEQ ID NO: 133 - DNA  (genomic), 1304 bp; double-stranded, linear
agacgctaacgctcactcacatgatgcctcagcaaagaaagtcctggtcacagaggaaaaagcctcaataaatcgccaggcagcaactaatggtttaccctggctggcagacaacgatcccattattcttcccccgaatattgcccgccatgccctcagccaccgcctttggccgggagagccagtaaaaaaaccaaccaaacccgagaaacaaaatttaatttcccgattggcaaatcgtacttatcattattataaaaatctgactttcgattacagctcatgctctgatgaatgggctgatgcgattagccaggcaatcagcttaattaaggcccaaaagactgagatacccgcgcgtactatggcggtacttacttttctggaaatatgtttttgtcagggctggaatgatgaaacctcatccgagttgctggatgaaattgtaagcaccttcggtatcgaatacgcaactgaaactgtcatcttctggtggcaaattgatttcgattttgactataaagatgaacatttgactttctttattaattatgcagatagcagcaaggacagttatagaaggaataacgacaaatttagtttacgtctgcgtaaacatttatcactagcagaagaagaagtatggcaaaattgcattgcaaaattactcgttgcgttaccagatatatcactctatcgccaaccgttaattgccattttaatgccagaaatacccgaagtggcccatgagatcgtacatcgtttacaccaggtcgcagatgttccacaacttgaaatgttgaaactggtagcgacagatccattcacgctcgaaatactggagaactatcaatacattgatgtatttaacacctatggtgccagttggtcagctacggtattacgggagcaaggtatagcggcactggctcgcctgactccctatgctgaagaagataattgcggtgacgtactgaaatgtattaatcatccgttggccattacgaataaaaagtgccgaaaattttccttctgcaacgatagtggcattagccgaagcattggtaaaaaaagatgataaacgcaaacatacattgctggtttcattacttaatgcaaatcctttatttgtcgaaaaattagtcatcggattatcgtcgcaagcggcaaatttattgcaacaatgtcagcaattgctgaatagtcgcaatgaagattttgcaaactcagaaattctaccaatggtactagtctcgccgccctgggaaactcaaaataaaaataacgacaacagtcctgtgggt

SEQ ID NO: 134 - DNA  (genomic), 935 bp; double-stranded, linear
aagtcgcagcacatgcaacttgaagtatgacgagtatagctttcttaaagggggaaacggtattcccccttagatgcgtttcaatttgcccgttacttcaacaaatcaatcaaccgtaacagagccactaataactccagtacggcaatgagcacggttaacttttgtgtcagcgtgtccatccgctctccttattaaggagcgcaacaccagcaccttacccttacactgcctgtcgatactggtttacgtatgttggtacgaaacgttgctctccggatcagggcaccgcctgcggcaccacccgtccggcagccaggacttaaaattggtccgatccggcacaacctcccaacgggcaggattataaatctcactcactgaattgcaatggagtgtggatatggttataatttattcgttggtacgaaatgttgcacaatcagcaagttagcgtcactgtagtaaataaaagaacctgcctcaccagcaggtttttttattttctgcgatctactttccagatatttttttgccaatagcccaccataaatattcacatcccggtcaaatggtgcgttgaatataaaatcgatgaatttataaataaaaatgagttatatgatgaattaataaaaacagtaatcattttattaaagggggaagcggttttcccccttagatgcgtttcaatttgcccgttacttcaacaaatcaatcaaccgtaacagagctactaatagctccagtacagcaatgagcacggttaacttttgtgtcagcgagtccatccgctctccttattaaggagcgcaacaccagcaccttacccttacactgcctgtcgatactggtttacgtatgttggaccacgatgttgcactccggatcagggcaccacctgcagcaccccccgtccggtagccaggacttga

SEQ ID NO: 135 - DNA  (genomic), 1313 bp; double-stranded, linear
attgaaccgccccgggtttcctggagagtgttttatctgtgaactcaggctgccagatcatcgtttccgatggaagcataataagctttttctgcttctgccggaggagcatggcccagccttcccagcaatcgtcgattgtcataccagtccacccacgtgagtgtggccagttccacttctgcacggtttttccagctcttacggggtattacctccgctttgtaaagaccattgatgctctcagccatcgcgttgtcatacgagtcgcctgtactccctgttgatgccagtaatccggcttcttttagtcgctccgtataggccagtgacacatactgagagcctttatcgctgtgatggatggtgccagacggacgacgggcccacaacgcctgctccagcgcatccagcacgaatgtcgtttccatagacgatgagacccgccaccccacgatgtatccggcaaacacatcaatgataaacgccacatagacgaagccctgccatgtgctgacgtaagtaaaatcagccacccacagctggtcaggtcgttctgccacgaactgacggtttacgcggtcgcctgcggcaacggctttccggctgatggtcgtacggacctttttaccccggagaacaccggcaagtcccataaccgccatgagacgtgccactgtacatctggccaccctgattccttcccgtaacaactgacgccagactttacgcacaccgtacacctgatgattttcatcgtatacgcgctgtatctctctcttcagccagtcgtcgtgctgcgcacgggcactgcgtttatccggatgatgtcgctgttgctgacaatggtaatacgttgacggggcaatatgcagttcgctgcataccggtccgaccccgtactgctcacgcagcttatccagcagtggcatcattttttccagaggcggtcgaactccgccttcgcaaaataagcggaagcctggcgaaggatatcgttactgcggcgcagttcacgattttcacgttccagctctttcagacgctgacgttcagcgctggtgagcccaccatcaccgcccccggtatcccgctcatgctggcgaacccagacacgcagagtctccggcgtacagccaatctttggggcaatggaacaaattgccgcccactgtgagtcatattcatcctgactttccagaaccatacgaatcgcccgctgacggacttcgggggaaaaacgagtatttttagtcatcctgtttacctctttctcagggagtttagtctccaggatttccggggcggttcag

SEQ ID NO: 136 - DNA  (genomic), 25 bp; double-stranded, linear
ttgcgcatggccgccatacccgtct

SEQ ID NO: 137 - DNA  (genomic), 48908 bp; double-stranded, linear
cctgtcacgttacgcgcgtgacgcaacatttttaaaaatcgacgaagatcgtccaggagcgccgtttttcaagggttggatagatgattcgtttaccatgtcgatgaacttcgacgaatttcgccgataaaaagtgtcccatacatgccccattgatgccccataaacaatatcaggaattgacactggttatccatacagataaaaataacacctgtacataactacagttacaggagggtgttatgcgtgttgagatctgtatcgctaaagaaaaaatcactaaaatgccaaacggtgctgtggatgcgttaaaggaagaattaacccgacgcatcagtaaacgttatgacgatgtagaggtgatcgtaaaagccaccagcaacgatggcctttctgttacgcgcaccgccgataaagattcagctaaaacttttgttcaggagacgctgaaagatacctgggagtctgctgacgagtggtttgttcgctaataaacacgtaaatcggtaacggctggaaatcattcaatactcgcactatcgaaagttcaccagccaaccgcgacacgctcttacatacgaagtgccgcgctttccttaataattttttagcagtactgtgtaaataatgagcgacctaatccatgcatgacgcgtagtgcctattgtgcatctttctgcgtctctttttactggacccaagccaatgatgctggcgataccattcccgccaggcccacttacaacagtaaaattcggagctctgcctttacatacaatacaatctacctaacaaatatcccccggacattgcaacacaaaaaccggagccggactccggttttgtgaagctgtcgggttacttcatcccgccaatattttcccacgtcccgtcagcacgcaggatttgcagcggtcttaccacgcactgtatctgctttttatccgcatccagtatcaccacctgcgtgattaccctgtcctgctccggaataataccattctcatcggactccaggatgtctgccggccccagtcgcagttgtgctgtaagcgactgcccgtgttcacggccatcatgctttccgcaaccacacagacgctgcataagtttttttagtatattcatgtcattctcctgttctgcctgtatcactgcccacttcatccagccccttaacatcctgccacggcccgtcaccaaacctgacctgcaaatgccgaaacagcccctgaacctgtgtggcatctttggggtcaagaaaggtcagtccggtgatgagtgcgccatctgtatccgggaaccagccattgctgtttgtctcaataatgctcgccggccccagacgaaaacggatttgtgtctcccccgggtcgcccttcggtccctgaggtccggttgcccccaccgggccagccgcacctgtttctcctttcggtccctgtgggcctgccgggcctgccgcaccggtatctccctttggaccctgtggacctgcatttcccgtcagaccggtctctccccgctctcccctgtcacctttcggcccctgcgggcctgccggaccagcatcacctgccggtccccgttcgccggttgccccggcagggccggtgtcaccgcgctctcccttatcacccttcggcccctgaggacccgcgggcccctgttccccctttggcccgggaggtcccaccacggtggggattcggtttacggcctcttccgccgctatcctgctttgttccgctgactgtgcgctttctgcagactcccgggctttttctgttgcggtcgttgcatccctggcagcannaccggcagcactttctgccgtctttctcgacaattcagcttctgctgcactttgtgatgactcactggctttttgagcggccgcagaagccgaggacgaggacgcatcctctgactgctttgcagcggctgcactttctgccgcctgccgggctgactccgatgcatcccctgctgaagtgtcagcatttgcagcgctctcttctgcctgactggctgatatgccggcattcctcgcggacgtctccgcctctccggcattcttcttcgcctcctcagcgtgacgcgccgcttcttccaccatcagttcaaaacgacgcagtgcctccggccggacgtcatcctccgacatggcaccgagaaaatcattcagcgtccccggttgagaatcttcatacacggtgatggtcccggcatgtgacggcgggaacctttccaccaacagaataacgctgtactgaccgtactcaacgtccatgctgtaacgaccggcttcatccggattttcagaggccaccgtgttcaccaccaccgtggcgctgttacgtctggctttcagttgaatggtgcagttctctaccggttttcctgtgccgtctttcagtacacctgaaatctttactgccatattcaccccacaaaaaagcccgcctgaaccggcgggctgtcataacactgtgttacctggctaatcagaatttatagccgacacccacgatgaagccgtcagtgcgccagtcgccactgccggagccttcataagcaatatcaatggccacggattcggtcgggttaaactgcacgccagctccccacgccagagacgtgttgctgtggcgaccgtcatcacttccggtcagcacatcgtgcgttttccccttgttgtcagttacgcgaagataatccccggagaaagtcgacacacggctgtaagccactcccgccatcgcatacgcgctgaaccattcattcacgcgcacagacggccccgccattacgctgaaccagcggttacgcacggaatcttcatgccagcgggtatcgctgtaacgggtaatctggcgattcctgtctcctgcatagctgaatgacgtcaccagccccagcgtgtccgtgaattcataacggtatttcacgttaatcccgttaagattatcgctaccgggagcgttcgtcgagacatgaagataccccgcgctcagcgtggcctgctgctcagacgcccatgcaggcgcaccggatacggtcagacaaatggctgcggacaaaatggcggcataaagtttacgcataattacctctcgcttttctgcaataaaaaaggcgtcattcctgacgccctttattggggttataaatatttcaacgaatactgatgccggaagcagcttttttggtcacaatcaccgtacagtcggtgatattgcctgccccctgattgcctttctggaaaatcttaaactccagaatgacgctaccaccaccactaggcattatcaataactgcactgtaactaccgggaatggcccctttagtttctctggatgcgataatacgccgtttttgcgaacttcaaaaccataccccgtgtatcgcgtgcctcctgggttatttccgctccccggatcgtcatacgctataccgttaaaaataatgggcggaataataatctggcggtcaaagttatgatcatcgctgatggtgactgtaaccgtaccgtttggtgtttccgtgttaccccacgtaccgacttttttcgggaaggcttttgatacagctttaacgaaatcccctctgacctgggtcgcctccagcatgcccttaatcnnacagttctggttaatcgngacattgtngagcgctcctgagttcgcattcacactgccactgatatccgcatttttcgccgtcagtcgcccgtctggtgtcagggaaaatgccggaggattaccgccgctggtaatggtgggagccgtcagatatttcaggaacacttcattcatgaatatctgatcgccctgaccaacaaacatcggctttgtgttgccattcgcaggattaatcatcgcaatcctgtctgctgccagcagcacctgactctgcatgccgtcgggggtgttctcaataccggcaccgatacccgcaatataaaggcgtccgtcctgcatctgctgcagcttcactgcccacatgctgttcaggttattatttgtatcaacctgaaccttctgtatctgctggatcgctgcactctggtcttccagtttcttattgacggtctgtgttatttcattgctgacatccgttatggacgtcctgatttcagtcaggtcaggcgcaagctgaccgttatcaatctgcgtccacagctcctgagccagatgggttttccctatctcgcctttgaaaaaatccagatagcctgatgcatcatcactcggctgaccgacagcctctacaaatgccgatttgccaacggtgttcacactgcggatataaaagtaataatcatggcccggtttgatattgatactggcagctatccagtacagcgccgtgccaagatagcgggctgtggtttcaacctgcctgatatcagcaatccgcttttccgagaaccagaactcaaactgtaccgtcggatcataaaccgcaagatgcggcgtggcggttatctgaaaatagcccggtgtcagctcaatccgagacggcgctgccggtgcggcaatccggaacgataccgatgccggatcgccctgctgtccccacgcatttaccgcccggactgtcaacctgtagttccccggcgccagttgcgtgaagcggtatgtggtttctgtcgtcctggccgtgctgaccagccgctcactgccgtcatccgctgccacggtcaggcgaagcaggaagctcacgcccttcaccactttcggcgtgtcccagcgcgccagcacctgatattccccgctgtctgcggtgacttcggcggtcaggtgctgcaccgctggcggcgtgacaccattcaccgtgccgctctggtcgccgtcaaagtgcgccccgttatccacgatggcttctttttccggcacgtgctgcaccgccgtgatggcaaaggtgccgtccgtgttttcccggatggagacacagcggaacaggcgacgacgcagtgacggcagggagagtccccatacaccgtatgtctccacaccatcaggcagggtgctgacctgtatccggtccggcgcggggtgtgcagtgatggccacgctcaccggcttaccgctgccgttaatcaggttcaccgtggcggcacctgtctccggcagggtcacctcacggtccagngtcagggtgcggctggcggcatcgatggacaggatacgtccgccggtcatggtcccggcatagtcgttatcacagatttcaataatgtcaccgggtgtgtgacgcagcccctgtgacccgagcgtgaaatccaccgtctgcgtttccagcagtccggtctttatcacccacagcccggcacggtgggcctgaccgcgactggtgcagccgaacgcatccatcttcagcaggttgcgcccgtagcgcagtatggcttccgggtcttccaccagttccgtggaggtctgccagccgttctgcgggtcggtgtaattcacctccaccgccgtgtggcggtccttcagggcgctgaagctgtagcgaaaccccacgccgttatcatccaccaccacatcgctgttggtgtacggccacaccacatccgacgggcggtcctgaacgaacgtcagcgtctggccgttccataccggcatacagcgcatcgccgagcagaaatcactgaggacgtcccacgccttacgctgttgtgacaggtatgcattaaaggtcatccgcggctctgtgcccccgaaaccatccggcaccgtctggtcgcagtactgcgcaatggcatacagcgcccatttgtccacatccgccgcccccagacgttttcccatcccgtagcgcgggtgagtcagcatgtcccacagacaccaggccgggttgttgctgtatgccggtttcaggctgccgtcccagatgccgctgtacgtgcgtttttccgggtcatagtttgacggcacctgaataatgcgaccgcggatatggtagttcaccgtcatctgctgaccgccaaactgctccgcatccacctgcagccccacaatcgccgtgttcgggtagcactgtttcacatcgatgatttcggtgtatgacgaccagagcgtcttattctgcagctggtccgtggtgctgtccgccgtctccctgaccatccggatgttaaagggccggggcggcagattatccagaatcaccgacgccaggaactgcgaggtggtcttgccgttaatggtgacatccttttccgtcatccatttaccaccacgctcaagctgaatcagcaggcggacagacgtcgggttacggtcaccctttgaggtggtctccaccagtgactgcaccccgaaggtaacccgcaggcggtcaatgttcgcggacgtaatggtgcgcgtcaccggctttgccttcgtcacttccacgcccagtccggtttcagctccggaggactcaaagccttccggtggtgtctgctcctgctccccggcacgccagaccgcagtcacaccgtgtatcacgggattaccgtccgtgtccgtcagcggggttttgttcaccaggatactctgcagccccttcaccgggccttctatcggtccctcaccaatcgcatcaatcacactcatcatctgcgtggatttgagattatccttcgcctctcgaggcgtgtgcgccctgccgccacctttgcccataatgttcctctcaattggtattattaatcgcagtgataggatattgcacagctattgcgcgatatcatcagaacgctgtttgttaccctgtaaccagcaagctcagtctgttaacggaattaatgagggttttatgaaatgtaaaatcattgctgccattgccatgctgacagcagcatcatgcggatacgcagcagaacaggaagtcccaatgaaccttgtcagtgctgacggaaaagaagtcagcattggaaaaataaccattcaggagaccccctacggtctgctgttcacaccagcccttcactctctgtctgaaggcattcatggttttcatgtgcacgaaaaaggaaattgcgccccggcactgaaagacggaaaaccggtcgcagcattatcggctggcggtcactttgacccgaaaaacaccggcaaacatcttggcccctggtctccggatggacacctgggcgacctccctgcgctgttcgtgacgcatgacggaaaagcgaactacccggtcctggccccgagactgaactcattaaaagagattaaagggcgttctctcatgcttcatgctggcggtgataaccatcatgaccatccggagcccctgggcggtggtggtgcgagaatggcctgcggcatcattcaataatcagtcaggtaaggggcgggccccttacctttattcctcaggacgataaatcctttctccctgaaaagaacggcacatcctccctctctgagttaatgtttttgtcgtgacataagaataattccttacactcaatcttcgtaacgctcccgcagttcctgtccgtgagcactgcgggattttttcgcttttatgcctgccgcccgataaccacgacctttccgcccccgccttcatcacgggtactgatgtcctgggatatacggcgggagccaaccagcatttccccgtaaggcaccggcatcgggttaccctgggcaatcatgttgtccagcgacgaaaagtacgtgttctgtttaccgttatccgttgccctgtattccggtgtttttggcttcggggccagcatctgtgccacaccacccagtatcatgctggcacccagtgaaaacagcatcgtggtggcagaaaaaccgccggcactcagcgctgcaccccaggctgccatcgatgctccggccgtgaagaaagagcccacgatggctgccgcccccagcacaatctgcagtccaccctttccggccccggccagtcgcggcacaatgtggatgaccgttccctcacccagctgttcgtgaagacgggcgtacaccgcctccggtgccgtgtcatcaccggcaatacgtatctggtaccagccttcgttcatctgacggcggaatccgggcacctgtaacgacagcgcccggatggcttccgctgccgtgttcacatacaggctgaggcggcggccaaatcgttgtaaatccccgtgaaggcagatgcgtgccagtggcggtgacgccaggctgaatgcgttcgtcgttgccatttttcggaatacctctcccgtttactcagttgttcaggcagatggtgaagcagctcaccgttgccgcagtaaatggcggcatggttcggtaccgaagcaccaaagcagcacagcagaatatcgccaggctgtgcggaaggcagggaaatcctgtaaaaaccagtcgcctccatattgtccaggtacaggttctgaccgttgcgccaccagtcatcctcacgctcaaaatccggcatatcaattcccgccagatggtaggcatcccggaacagcgtgtaacagtccgtcaccccgtgctcaaagcgccgtcctgtcagatgtggcacacagcggaatttatgaatttccccccggcagaccagccaccaggacagtgcactttttatctgcagccgccggtcggcctcgctcagccagggcagaccaccgggatgactgtggaccagtgccacaatctccccctgcatctctgcccgcagccagtcttccggtgcaatacgaaaatacgcctccggctctgcagagatattcacacaagggatataccgctccccctccggcgttctcaccacgaagccgcacgactccgctggcgcacaccgccgggcatgcgccagaatcgctgattcagtctgtgtcataaaacaggatttactgcgaaagtttattgatggaaaggaaaccgccaaaattaaccgccatgccgcgcatctcacacccgcgcatgcacttgctgcatctgtccttacggatatccgtggtggggttgtcgaactcatccgccacagccccgcccgtgtaaccacactcatcagagcggtaggtccacatacaggtattcgccagcatgatgcgaccgggaaacagcgccccatccgtctcggtcggtgtagccagcacaaacgaggccgtcatggctgtcagctgcgacatctgctccaccacccagcggtcactcagctcctgctccgggtccgcctccggattgcccgcaacgaaattcaccgcatccagaaaacgggcatacacccggcggcggaccaccgtggcccccaccagactctgcaggtcctccgccatcccggtgacaaggccaaacagattggacaccgtcagtgacgggcgggcactgctgcccttcccgttcatctcaaaaccgctgccgtcaatcgggtatgcctgatattgccgcccctgccaggtgaccgcctcccctttttcattcagctcattacagaaaaaataccgctcaccaccctgcaccgtcaggtcgatttcccagagtaccacccgcggtgactgctctgatttaaccgactcgttcagactttcttcatgaatgtcctgcatcagttcaccacctgctcaatcgtacaactgaaatcactgtaccgggcgttatccgtgacgctccactcccggcacaccaccctcaccgtccggttatgtttcggcggtcgccacaaaaaggcacggtaaccaccatgccacgataaaaactcttccagccagcgccgggttgactcatccgtcacccggaacaccgcctgaaacgtcttcagttgaggattcagccctgtggggcggcgctgttcataaccgtcaccaaaccgcaccctcaccaccgacggcttctcactcacctgcatcccttcacgcgggaccagatgcagcgtttttatctcagccactcagcattcctccgtcacgtcgcatggacagcatcaccgcctgcacccgctggtcaatcagctgcacaagactgcctgccgcctccggccctatctggccattagtcccgtcattctgaatggcgatatggtagaccggggaatacaccagacccgcactgccgttcatactgcccaccgcgcgcacacccagcnagccatccgccgcccgggtcaggggcataatggcttcaggtccggcctcccccatcagcccggccccttttgcaaaggcaaagtacgtgggcgtatccacaatactgttgctgtacgcactcaggtttgccgaggtatacacgccgccttttgcattggccaccgctccgcccagccagtcaccaatgctgccgagaaatcctcccgcaccggacataccgtttgccgccgtcttaattccgttgacaatggccgcattcataagaacttttgatatttcctgcagtacggatgaggcccagctgcgccattccactttgtttccgttcagcatctccgtgatgttattcaccatccctgagataccctccgtcgcaagctgtgctgcctgtgaggcgtaatcggacgcattatccacccagttactgaatccctcctgcagccctttctgccagtccgcacgctgcgcatccgattcggcataaaaagtttcctggtctttaaggcgttcactcagatactgcgcgttctgtgccagagcctgtctgtaaaaatcctcactgatatccccggtctgatactgagactgaaggtccgcatccttctggcggaagctgtcgcggatctgctgcaactcccgcatgcgttctctggctcgctccccctgcccgtaccccagcagttcagcatcattcgacgcacgcgcagccgcattctcattcttcagtgtctcttcccgggatcgcaactgttcccggattttttgctggtcaatcagggccgcattgcgcagcagctcctgcttctgtatctccgtcagggttttcagttcgccctgcgccgtctggtacttcagcttcgccagctctgtattctgaccggccagtgccagttgcgccttctgctgcttcagcagccgggaaaaactgtcttccgctttttccgtctctgattttccaccccgggatttaggtttgttcgcctcgttattacgccaggcttccagagcattactgatataacgctgtctcgcctcctgatacgaatcccccacaaaaccaaggtcatccgccgcataccccagccgggcacgctctttttcttcccctttcagtctggacagggccagctcacgctctgtttttgtcagggcactctgctgtttatcatccagagtggcctgtggcagccgtaacggcacattcaccagtccctgccgctgctgaagcagttcattacccagccccagcagacggttgaattccgtatgctgaccgttcataaccagcatggactggtacaccttattctgctctgccgcctgctgacgaattaacgccacacgacggtcttccagcccggcaagcacatcctgaatggactgcgctttttcctgcagggatttcacccgactggcctgttcatcaatcagccggttctgctctgtcagcgccgcccgtgttcgtccttcattatctgaggcttcaggcaaagacattgacggcgttttatgcgcgatttcatctatcgtcagtgcatactggcgcgcagactccctggcctgctcctgattctggtacagcgtgtaccatgctgcagcccccagcatcaccagtccgggtacgccaccaaccagccccagcgcaccgctcatcagacgtgagcccaccgccgttgtactgttcagcgcattctgggcggcgcttctggcagcaatatttctgttcaggcgttcctgtgtggccgccagacgggcttctgcagcaatctgcatctccgtcccgcgggctgccgccacggcctgctgagcacggtacacggctgcccttgcccgcgccgtggcaatctgcgttcccctgaactgtgcttccgccagtgcaacttcattacgtgcagccgtcacaagtcctgccgtggcagacatcgctccggaggccatattgccaaagtaacgtgcaaccccgacggcaaccagcgcgcccacggctgttgccacattatcaatctgtccggcaacaccgttcagcatgccggagagcgtttttgtcaccccgctggcctcattcgcaccgcccacccaggccataaaggcgttttccaccttcgtgatactactggaaaccgtttccggcatggccgcatattcatcacgtaatatccccagctggctgattaacgcggggaccactttatccgctgtcagttttccgtcatccgccattgccttcagatctttacgggccacgcccatacccgcagccagtgcacgtacgatccggtcaccactttcattgaccgaattaaattcctcaccgcgcaacacaccctgtgccagcgcctggctgaactgggtgatcaccgaacccgcctcagccgtactggcaccggagattttcagccccgtggaaatggcctccgtcaccttcagtacatcaccggcactgtaaccatattcacgcatcgaggcagccgaacgggcaaacagggccgcattatccgaaaatgcggtgcctgtccgctggctgatatccatcagcactttctgtgatgacgcaaattcatcggatgactgtgatgcctgtttcagacgggcattcacggagctccactcatccgccagtgaaatcaggtgtccggaggcaaaggcaccggcaaatgcgccagccattccgacagcagaaccgcgaatttccgtcaactggctgttcagttctgccagggcacgtcgctgctcccgggctgccgcagcggcctgacgcccgccattctgcagggtccggtaatattcactgcccatacgggacgcccgctggatctccgactggaatgactgtgaatttgccgaaattttgataatcagttcacgtaacgtcgccattcacctttctccgggcaaaaaaaaacctgccacagcaggttttcatcattatttatgacattgctgcaaggctcagcgcgtcttccagcgccgcaaacggatccacctccggcttatcctcatcctcgccccagcagagcatggcgtccttcagtgcaacattcatcccctgtgccccgaaaaccgctttcacgatctgtgcattacggatatccccgcgctcatcacccagcggggataccctgtcgaactccatccacatcatcgcctcgctcgcactcaggctgtgccgcagttcggataaggtgcgccccagacggagcgcaagtcgcatcagaaagcgaatttccgggcgggctacttttttctggccgactctgcatcagcgatcagttccagtgcctgacgcagcaaccgggcatgtaccggaccatagacggccagcacctgctcacggtcgtccggagtgaacacccgttgcaggtcagtatcacacaggacatcgcagaacagcgtcacatccgcttccaggttacggcgggttttcgccaccaccgacagggtatcgtcatcctctccatcaccattgagcacttcctgccacagataccaggcctctgccgaaggctcccgcagcaccacgctgacatttctccattccggcaccttcaccgttttatgacggaaccccgacagtctggccagcgccagtgttttcagatcttttgccataagccttatccgcccgcaccattaaccgttactgtacacgcatcaraggtaatgctctgcggctgttctgcagaatccgttacctcgcaggtataagcccccttatcacctgactgcgtattggctttactgaaagtgtcagtagtctgtccctctaccggctgaccatccttcttccaggcgtgtttataaggcggcgttcccccgttgacactgactgacattgtcagcagcgcaccggtattcacggtaagtgtcttatccagatttttcacaaacgccagcggtaccacataggacaccggtttacccttcaggcgaagtgaaaacgttgcagccaccacgccgttggtaccggatgaccaggtgtgctgacgcacttccgccaggaacttaaagcccttaccggacggaaactgcaccttaaacgcatacaccgtgtcattgtcataggcatcacgcagggcgttctgggcctgattcagataaaaattacccgacatggaaatctcggacgacgcccccagaccgttgatgttctcctgctctgtggagcagagcgtggtcacatcaatatcctgtttctgaccggcggtgaactggacttccttgatggtgcagtccaggcgcagatattccgccttctccatggtttcagcagtcgccggggcagatgaaatcatcacctgcgtcagctgtgaacgttcatacaaagcagacattctgcctcctgataataaaaaacccgcacgcggcgggttatgggttctgttgaaaaaattacaccgtgacctgaaactccagggttgcacggtaacagcggttttccggaatatagtcctgcatttcactgacggatcccggggccagcagcattatggcttcacgggcgtcctgacgtatctgacgcgcctgcgtcacagtcccggcataaacgtctatctgcaccgacactgaggactccgcctgcccgcccatcacgtccgccgacaccgatgaaatcaggctgaaaaccacccacggaagcgccaccgacggcctgccatccagcagggggaccacatacgggtacacctgcccgccggcaagatgcgccagatgaggatacaaatccgcctccgtcatcgtctcagtacctcatcaatggcccggttcatccgagcaatcgccacctgtgccgcctgttcactgcgcacatcaaatgccgggcgcacaaacgggtgcggtggcatattcacggtccccatttccacaaaccgccagtagaaagcattgcgcgggttatccgccttcatggtgttatcgctgttaccggtgtccggattaacaccccggatatgcacaccggattccatcccgccatcgcgggagcaccgggaaaggaccaccacattgcggcgaagttttcccctgcgtaccggtgcccgtgacaccacttcttctttcagcacattcgcacccgcacgggttgcctcacgcagcacccggttattttccgcaccactcagaagctgcaaatcgcggctgatgtcctccagccccgaaaaatccagcagggtttcgatcatttttcccctcccagccgacagagaatttccagacgcccgccggttgcatccggaaccgggaccccgacgacattcaggacatggtcacgccagggaccactcagcacatgaagtcgtgacgccgccgtgatttcacgaccagactgaccgcgtacccagatgcggatttccgcctgcgccatttccgcaccggactgcatccgctcccggctgctcctgccccggatatccgcatgaattttcccgcatgacacccattcttccgtcatttctccggcagcattacgggttaacaccgggttcagaacactgatcatctgtgtcagacgacctgcagatattgccattccccctcctcataacaccgtcggacaacgcaaatcgtaaatcagcacggaaacagaaaacggcagttccccctgcacgaggtcttcccgctcagcaagatccggattccggtacagcatcccggtcagtcgcatggcagcccccttcatccgggttaatgcctcaccagggatcagctcaccgtcctcactaatcactttatcccggctgccctggatgtaggccagcagcacggcggtagcctgacgaaccttgtccatcagcatctcatcatccgcgtcatggtcaacacgcagatgtgccttgatttcttccagtgtcagtaatgctgtcactttccacctcctgcatcccgcccacgttttgcagccagagtccagcctgatgaatgagcttctccgggcttatcaccggtcatactgttgcagtgccacaacgagccccccacgtcaccgtatcgccggggtggtaagtttcgccgattctgaacacaccacggtagagcatcaccggcagggaaaatgttttttccgtacgctggccactgctctgccggaccaccacagagaacgaccgttcacccgtcatgctgacgtcaatatccgccaccccgtcaaccaggcattcccatccccgcatcccgtacgttttttcatacgcccgccagagtccaccctggtgtgtggcatacgagccccggggaaaggatttttgatcgtcaatggcggggagtatttccagtgccgtggcatcacgcccgtcctgcggagccggcagggcactcaccgcctccagaaccgccttctgcagaacatccggatcgtagtcacgaccatcacgcggaacaggaatatggcttaccgcctccttcaccatctgttcaagcatcggatgcacatcatccggagtgatacttttaccgtctgccggtaccggtattttcgcgaccgcatcattcaccgccttctgcagaacatccggatcgtagtcacgaccatcacgcggaacaggaatatggcttaccgcctccttcaccatctgttcaagcatcggatgcacatcatccggagtgatacttttaccgtctgccggtaccggtattttcgcgaccgcatcattcaccgccttctgcagaacatccggatcgtagtcacgaccgtcgcgcggaacaggaatatggctcactgcctctttcaccatctgctcaagcatcggacgcacatcatccggggtgatacttttgccgtctgccggtaccggaatattcgcaaccgcatcattcaccgccttctgcagaacatccggatcgtagtcacgaccgtcgcgcggaacaggaatatggctcactgcctctttcaccatctgctcaagcatcggacgcacatcatcacccgtcacgcacttctgtaataccacagactgagaagccagtttttcttcaaacgtttgtgcctgcgcggctattttctcctcaaatgtgcgctgtaaatccgccagcactgtggaaaattcttctcccagtgcacgaataatggacagttcccgttccgtcattttctcagtatcccccctgaacatcgctttcaccgcatcatgctctgtttcactgattgccttattaccgtcagatgcgccgtcaggcagctgtgatgaaactgttttcccggcagacgcgaacggatcctcacgggcatcacgacgggacagcgcctccagactgtagttctgctgctgaagatacagtgcatcaccgccggccaggggcggcaggttctcccgtttacgggcctcattgggcgtgagaagcgtatttttcaccgcatcccccagcgttttcatgcgccgctcactgtccattctcagcagcgtggtgacatcaaattctgtactctcgttttcccccgtttccagcgcctcatccagtaacagttcaatggactcaatcagcgtctgcaggcactgggaataatactgctgctccagcgcctccacgttgtcactggaaggcggttgtcccacgccaatcttgtaggccgggacacggaacaccgaacagacaatttcagcggtcatcttcagttgttccaccgtctgcgcatccaccggtgaaaacgtcgtggggttgtattttgccccgttgctcagaatggccgttttccccgcattttcgcctgtatacccgctgtcccagttgctcttcagttttttcgcattttcttccgtaatactgccggggatctcaatcaccccggacggcctgccgccatttctgaaaaaagacgtcgaattttcctgaatatgatgcccctgcgtggccgccagcccggcggcatacaccggcggcaatcctataagcggatgaaaaaaacagttaaaccggtcgtggatcacttcccgggcaggcaccgtcaccgcctccgtgatcccgcagttccggtccggcgtgatgcggtagaacacctcgccgtcatccgccaccagaggttcaacccggctccagtccagaatacgcagttctttgatctgcccccgggcattacggattttcagcaccaccgtattgccatgacgcagtttggcgttcagccacagttcaaaaaactggatgcggttctgctgggcgttgggacgacgacagaggcgggcaatatccccccggcgcgtttccctgcgtatcccatgcgcatccgtctgcataagacgcagccgcattttggcgatatcctgggatatcagcgaaatacatgcaaacaccgcatgaaaggagaggacggcttcaggatcggctttcacgccctgctgccaggcgccggaaaagggctcagccaccgcctgaaacaggctggtccagcccgcctctcttacgtcacgtcctgatttctggttttttcgggttcgccgtaaaaggttccacattcgccatgctccgcatcacgtttctttttctgacctgccggacgtcgcgctgtgatgtactccgccttccccaggcgaaccagcacctccgcacacggctgtgccacatcacggatatccccggcccgggcatcatgcgtgccctgcagatatcggatctttgccataacctgttacgggaggcgcacgcctcccgtcctccttatcagactcagccgccggacgcactgccgtagttcactccggtgatcaccgccaccgccgcagtacggcgacgacgccagttgatccagcgctccgcacggatggccacgctgcctgtctggaacatggaaaccagctccaccggggacggcgtggtactgtcgccgcccggctcagactgcatttccagtgatgcctcgcgggacatatccactgccacgccgccgtcatccgccagataaatatccggggcattcaccagcaccagctggtcacccacgtactgggagacaatcaccggcagcccctggaaggagccacccagcagggtcatgtccgggtattccttctgacccagcgcatttttacgcatggacagtgccagggcattggtgctggacatcagccagaccgcaccggtgggctgcaggtttgctgccacaaactgtccaaacgcagcctcggcatccgcatccgggttaccggttgatgccgtgcccttcacatcatgggtgatggacgccggggagacatctgccactgcggcttttttcgggtccacaaagtctgtatccagacgcgccaccaccgcttccgccagcgcattacggaccagtgcatcagcagccggactggaaaaacggatcaattcttccgtcagtaccgcaatggccgacaccttcgcatgactgaaggtgatggattcaaaatcaaacttcgtcaggggttttgccttaccctcacccacccagccggcagcaccgccggacacctgggcgtgcacacggatattgaatggcacctgacgaagtgcagggatcccgccctgaccaaatcgcccgataatggtctgcggacgcaggtaatcaataaagtcctgtgcgtattcctgatattcagacaggctgcctgcccactgcggatccgtggtggtccccgcgcccactgccgatttcaggacatgatgcagacgactgtcatccggatactgacgacgggccacttccagggcttcagatcggacgcctttagccgcagccagcgatttggcaaagcgggcgaagccaatccccttatccagtttctgctccacacggatcaccggcgcagaagccaccgcggccacattcccgttaccggcctgtttcaccggctgcgccgtggcggccttaccggcttccagttcacgcaggcgcttcaggtgcgcatccacctgacggatttccgctgcggtgttgtcgtaatgctcttcctcctccacatccagcgtgcgcccttcctctgcggctttggtcatgacctcctcaagggaggctgccagcgctgcacgcttgttttcaaaacttttaatctgttcgccaatattcattatggtcttttccttatgaaaaacggttgttgactgtgccgcagcgccggcagaagatgcgattttcaccaccggtttccggttgccggacgcggcagaaaacgggcggtcgtaagatttaatggtccggatggtgcattccgcattcgcgggcacggtgacggcagacacctccatcagttcccagcgcagaaaatgcagtccgcctccgtccagaaaggtgtattcatggggacggaagcccacggacagccccctgaccagcccggtcttaatggccgcccagacctcatccagccgggcagccagttgcgacggcatatccggtacgggcttcaccagtgttgccgtgatttccagcccttcgctgacccggcgcaccgtacactgccccaccgggcgggaatggtcatgctgccagagaaacgggatcgcactgccaaactccgcgccctccggctccaggatgtcaccatcccgatccggagaaggcgttgacgcaatcccggtgatcacccgttcatcctcactgaaggatttcaccgtcagcagggaacaggcccgtttaagantcacatcagcctcctgaaaataaaaaaaccgccgcagcggttcatgatggttacagtgtgaacagggttatatgaaaaaaaccgcatattctttctttttcggttccgggttaagggacatcagggagaccgcattgaacagcgccatcagcgggtcaatttttccccgtccactggcctgtttggtgataagaatggcgttacctttaggctccacccgggcattgccgacacaccaggccatcaggggctggtcaccatgcaccagcaccccttcagccagtttgcgctcggtggttttaatggccccgcccagtttccagccctggcttatccccaccacaattccgtcggggatcccggcttccgccagtgaatccagaatctgccccacacctgacgggtcaataccgatatgatccagtaactcagcctcatgaatgcgacgcacatactccgccacttccgccgtgtcatccccgacccgacggacaatcgtcatgtctccacaggccacaaaatcctgaaaccgggatgcctcactcttccgtctgaccaccgcggtttcatgcacccaggcatggccccagcccagccattcgcgggtttccctgtcacggccagtcacgtacattcccagcagatcatccaggcccccgccgtcaatccccaccgtcaccacatcagcgcgctgcaggatatcgtccaggctgacgcgcctgccctgctgctcccagaaatccgcacccgcccagcggtcagaacgcagggcaagaccaatttccacattggcatgttttgacatgaagccacgaaatgcttcctcaccagcctcccgggctttacggtactcccggtacagaaaagcctcatccaccgaataaccgagattcgggttaaccatggcgaggttttccatcagcaggtgagccccgctttccaccatttcaggaggatgctcaaaaatcaccggcagaaagtgcggatcatgaattttgccgtcacggacatcccgggcgtactgcagtttctgtctgaacaccccggctggcggctcattcgactgggtggtcgtatacaccacaaacccttccgggcgggaggcaaggccgcctatggcttcacgtaacatgtcctccgctttgtactgcttgccaaataaccacagttcatcaatcagcgtccccacggacttgataccggataccgtattcggatcggcagccaccaccttcagggtggtgtccgtcaccctgtgggtgatggtccggatatgtgtctgcacctgacagaggtcatccagatcatcgtcccgtcgtaccatatccctggcagggttgaaggcgttagccgccacctccacggtcggggccagaatggtgtagcccgccgcctgccgccagttcagtaacagcgccgtcatcatgatcccggcagccagcgtggacttgctgtttttcttggggataaggataaaaacttccttgatatggcgtacaccggtctgcgcatcgtaggagccaaacagggccgccaccaggtcaaacacccactgtgcgcaggactccccgaacgtcgggctgcccggtgcatccacaatccgcagttgtttaaaaatcgccagggcatgtgcggcctgctccggataaatcggagccggaataatcgacagcccctttttcaggcgctctgcccagtccgggcaggccgtgctccacacaggtatcatccgttgccctcattatcattattcaccaccaggcggggtggtggtggcaccgcaaaacggttagccgcttttttcgccgcgtcaccttttgccgattttttaccggcatccccttttttgtggtgcgtgaactgcgccagcttataagccgcatccagcgccagcctggggtcggtattaatgttctccaccagaagacgccccatcgctttcaccggatcgggaagaccgtcctccatatactcaataccaggagatatcaccacgggcggtggcatctccggatttgtttcgtccggctgtggtattgcagccgcctcacggcgacggggtttatcctccggctctgattttttctgccgataaacaggaacctcatccacctccaccgtctcgcactgtttacgggctataaacgcaagcacctccggatcttttgccagctgcgagcctttaaccctggctgtcttcgccgaataaccggcggcaagggctgacgctgttttgtttttcccggacatgagcgccagcgcaaattttcgtttttgcgttgtcagcacagcctcctcccgggtccagaacgcactcagccgggtatggttcagcccatttttcccggcgtctcatgccgcaaatgttaactgctgcctggttaacatttgctgaaaaagcctgttaacattttttccgcacaacaaactgaataataaagataaaaaccgcaaaaatgcccgggcagccagttaacatgttaactgccctgaaacgggaattttttctctgcgtgagagggggcgcggtgtccagggcgatcgttttttttcgccggatgatcccccccgggtctggtcacaggccagtgattccgtcggccctgagcgtgccatcaggaagctcaggcaacgtcggatcaggcataccactcgccgcttcactcgctgacttctggcgatggcattcagtacagagggtccagaggttcgtctcctcattaccaccaccgaactgaagtgcaatgcggtgatcgagttcactgtcacaaaggtcaaccacgcgtctacagagacaacagtgtccggcatccctccgccagatacgacgtttgagggaaacccgggcactgccactgacacgacgctgttcccccctcaggacatttatccgccgggtgttcagagttttgattctgcccggtaacgtacgaagcacagccatgtaaaatcctcgccatatagcttgtcaccagaggaaagaaaatgtcatcgaaaaaccggccccgcagaacaacaacccgcaacatccgatttccaaaccagatgattgaacaaattaacatcgctcttgaccagaaaggttcagaaaatttttctgcgtgggtcattgaatcttgccgccgggagctggcagcagacataaaatatgcccgtcagttgactataaaaaagaatgatacacagtatgctctgcgatggctgttcatataactatttctttatattgctgaatttataaaaactcacagacattagctgtattaattccgaattgaaataatcagccatatagaataaaaataaagcataacaataataatcttctacccaatcagtacattactgctgtgactccaacacggcagtttttttattgaacagattccagtttcttccaccatcgcaccggacgggcgaccatgaggggagaacgccgcgctccgtttacgcggtaaaccccggtgtgtatcgtttttgattatccccgcacactctcgcagaggagtctccctgtcgggctgcggtctctgttaatgcaggaatacggcgacgatacggcgcatcagcaaaacttagttcaggcactgagtgcggatatagtcctgtgccccttccagctgcttctgcattgtcatcaaccgttctctgaggatgaaataatcccgttcagcggtgtctgccagtcgggggacggttgcattatccacgccggaggtgccggtggcttcacgcacggtaccggagcaggtggcgttgatccgcaggcgcttacgaccagcggcaacatcagcacgcagagtttcattttcagctctcgcatcggctaattccctcgagtattttgcatcgagcgcagcaacatcacgctggcgcacctgcatgtcagtaatggtggcattcgcctgttccagctctctggcttttttatcgcgctgcgctttgtaggtgagcgcgttgtcacggtaatggtttgttgccagccacagcgcaccatagccaaccgccaggacaataatcaccacacacagaacacggttcatctctctttcaccccaccagtcccgataacgtcaggactcgccaggcggtggaaaagaaaatggcaaccagcatgactaaaaatgaaatgccgacaagtacacagaggctcttcaccagcgttatgagtttatctgatatcattagccaccccatcaatccgcctttgttattttccctttgcctgtatcagccaggacaaaatcaatcagcatattcgcttcatttaccagcgtacggatttttgatacatgcgcggctttaacctgtttccactcattcagcccggtagcaaacacactggcaatgtttttatcccgtttcatgtcagcacaagcctggttgagttcttccatcacgctcattttacggggattaacgacaaaacccttcgtccagtactcgtaaagaacatcgtcgcactcttcctgataccggatgaccttatcgcggatttcgggttttactntgttgggattaatggtttgtagccagccggcaagttttcgaagtggcatggacaccatattgcgttgtttcccatcctcagcaaccataacgatttccgttatagttgacgcaaaacgctgtcttaacttagccaactgtgattgccaggccagccccatccccgcaacgacaggtttcatgggaacgtatggttcgccattatggttaactacataaagagagttgccgtgaaacggcacggccatcatattcatcggttatttccttttagtgatgaaccttgtctcacaggaatccagcccacagaaaggcaccgacagccaaaccggtatcctcaagggtcatcctgaaaggttctgtgttgtgagatgcgcgtgagatgcgcagaaatgacnaaggcatcnttacggtgcctgagtgttaaacaactgttttgactttattcacttacattttgccaatttgcaggatttcgtgttatccgtccatgtaagcaaacctcatttttcagcaaaatattcttcttatctgtcgattccccagcacgccagcgcgctctcctggtcacgacgggatacctgaccgtaacagttgtttgaacgaatacggcagtctctgccaccgtccttaatccaccagcgaatagcttcgcaggcaccttttcgatcacctgcattaattcgtctgtaaaacgtcgacgggaaacacttaccgggaccaatgttgtacggacagaatgacgcgatccccgctttctggggttcggtcagcggcactttgatgtttttctccacccatgccagcgccttatcacgctcaatggcgttaacccggtcgcatttttccttcgacagcttcatgccaggaataacaggcttaccatccacccgggtggctccacggcagatggtccagatacccgcaccatcacggtatgctgtggtgtggttaccttccttttcatccagaaactggtcgaggatttcaggcgcagaagcacctgcggcaatcagcgccagaacggcagccgataaaccatagcggagtttcctgctcatcagcttactctccccgtgccgccttacgccggtcttctttaatcttgaaatacaggttcgtcagatatgtcagcagcccaaacagcagactccccagcacgcctattgccgcccactgagacggggaaaccctgtccagcaactgcaggaaccagtagcccgttcccaccgctgacgtggtgtatgacacacctgttgtgattttttccatctggtacataccccgtctcccgcaatccggaagctcacaacaataaaaaagaccaccggcacacaccgatggtccctgacgcatgcttacatcatcatgtcgctgtccggtgtggggtcaccgctatctgaagcactcccctcacccgcgatgccttccggctccggagctgccggtgcgcccagcagctcatccagaatggcatcaacctctgcatcaagacgcgcttccaggttatggcgaagtttctgtttcagtgcgctccggacttcttcagagcgcaggacttccttcactgcttcagcagtgaccagggatgtaatttctgacatgggattttctcgtcgaaagatgtgattaagaaagttgccgctaaatgagcggctcttcgggtttgcttccggctgactgactggcgctgattttctcagcggcccttttgtcaatctgtctgcgccagaagtcacgcatggccctgtacccacccgaaaggagatacagcacacagaccaccgtacagaagtacagcattaactggttcagaaatgtcataatttctttccgttattgttgacaataagaactgttttcatttaaaaaaccagagcacgaaagtatcgttcctttattttttctccataggtattaccaccgccagcgtccattcctgtcgctggcggttttttttatcatgccgcagtgtctgtgttgttcacttccaccgcaatgctgtcaatcagcaccgggtaagtcgcacctttggtaatgtctgtcacatgcagtttatccgccgcaaatgcactgaccggtgactgcgtcagcgtgaacggtgtgccatcctgaccatcaataaccggcgtcacctgaaggctgttattcccggcaaagcggaaggccagcgtatgccattcgttatcaaatgcgccaaaggttcccagtttcaggttgtttgtcgccactttcgcattgtggtacatcacattcaggtcttttgcatctgtctggatgtagaacgctgccagcaggttattccccccgtctccggtcagggcaacgccctgtggcagtgaagataccggccagtaaaacgccataacatactggttcgcagccagcactcccgaaaccttaaagcggcagcgaatctgcccccctttctgtaacagagccgcaccgttgcccgcggcgtactccagcacccagctgcttttaccggcttccttggtcagcttcactgccttacctccggttccctccgcatcgctgaccacttctgccctgccgccactggctgaccatccctgtactttcaggcttccctctgactcgctggcaaggtaagagagcagtgttgtgacgcctgtggcttctgcaccggaaggcgatgacgggcgcacctctgatactgtcgatgatgcccccgcgtttagcgccactcttcccgcatggcgcaaaatcgccgttgccagacggtcggaaataatcccacggcgtgcccaggcgctgaaatggctcgccctgtcctgtgacgtccaggtggctgagctgtcacgccatttcgaaccgtaatatccgatacccggaatgtccgggtcttcttccggtttgttcgtcggcacattcaccccattctcatccgtcatgaacggtacgaaatggatattcttttccgttttgtttttgtagctgccgtacaccgtctggtacgaggattcgttcttctgcttccagaaatacgtcgtgtccccgcatatccagggaacaccgtcagcagagccaccgacgcactgacctgccatatccgccaggtctgcacggaatttatcaaccagcgcaccaaactgtgctgcgtgatttgccggcgtaccgccaaaatcaaattccccctgcatccacaccacggcaaacagcacatttttcggattcttcttcagtgctgcttttgttcgaccgataaggtccttatacagcggcttgtccacaccccagcgggttgaattctccgaggcaccactcgcgtcactgtatgtgccatcggctccggtggtgaacgctgaaccaccacgacagcacggaaccagcagaatgcccgcattcgccggtataaacggcagcaattttttggcgatatgcagcccctgccccacggttccgtactgcccctttgacaggtccgctttcggatggttaaggcggctcatgtcctgcacatcatgcagacaatggtccgccggaatgatgtcgttatatttacaggcgacaccgcccggtgtcaccgtactgcgacgcgccagctgcttaatgcgcgggtccggacggtcatatgtctccggcagcggaagaccttcaccatacgacatgccgtttgactgccctgccagaaccacaacaaagtaatacccggggtcgctggtggcgctgattactgcaccttctccacctgtcagcttcaccacaacaggtgtgctcacatcaccttctgcgacaatcgcctgaataagtgctgcgccatcatccgtatacgaagaaaacggcccaccgtatggttgccatccttcacgaattttttgcgcaagtgcatcagcaaggtctgacggcgatgccgccctgaccacatcgtagtgtttaaatgccatgaatcctcccggccgggataatattgtgagtaaaatgatgagcgggctgaaatccggaagttacaggacaatggcagaagagagacaacagcccgcaatacgaaaaaggccgcgctattgcgcagagtgattactgtcggatattattcgccagctgaaatattacttcacgttttgttgtttattccttgccgccagcgtctccctgcgcgggctttttttgtccataagaaagcccctccggagaggggctggagagtggcgctatgtgccattgcatggtgccgggtgcctcccggtgagttcggcctggtgccaccaaacccgcgtattctcgcttacgatcatcaaagagatcataccgttcaccagtcgcccctccgcacagggggattcaccatgcagaaattttctaacacatctattatcagaccggcaacaactgactgaattgagatgtatttaacatttatgaatctccgcctgctattttcactgagctattctaagtcaacgaaaaataacttcgctgaatccccctccattatgacaggcattagttttaatggttacagtcatccccgtaatttgcgcactgagaagaagagactgaagattccatctgttggtaaataattctttatcacccactttaactgtaaaggtatcgtcatcattatattttgtatactccacctttccagttacacaatcaggcgtcgccagcgcacttgctgaaaaaaatgaaagcgatgcagctattaataatgtttttttcattttaccccctcaactgctaatagttctgcgcatcagaattgcccccagagtggatgaatcccacaatattttattgtgcgtaatcccacggactcttccatctgccggacacatagaaggaaactcatcagatgccattctggcaactcgcgatgcatgatgatgacaattcagtattaatgccacgcttcccagaattgcattaatgcttccaaaagaaattcttcctacacgaacagagtcttgtccatgataatcaggcaggacactactcaaccttccccagttcaatgtaagatcaacatcttcagcagtcattacataagaacgcccactgagatcatccagtgttgtacgaaatcccctctgtatttgccgaaaacgtaaagcttcagctgtcacagtaacaaaccgtaacatcgctcttgccacagactgcgtcagtgaggttccactatgcgacattaaatccagataagaagtagtcaacgaatggcgatttatctgcatccccgtacgactgatccctgcaacacgctgtaacgtggtatagctactgtcaccagacaatgtaaccgctgttgtacctggaaaggtaacatgtgaaaaatcagcaaagcgataaaaaacattatttgtcctgttaacaaatcctgtcacatataaattatttcgttcaacaataagccgtagattattaaaccgcccttcctctggatctatccctctgacatcaactgcaaacaaattatcccctgtgccactatcaatcatcagtaaagacgtacctcctgatgaaatagtctgtaatggagtacctattgcagagcgaatgacattcagcgaatctacatacgtctttgcagtcgagaagtctaaggtaaattccttcgcaaccacattaactgaaaagataacaaagaaaaaagttagcactctaaaaataattattttcatattacacaatactccttgagcaccatacgataactatattcttgacatcctccaccccctgaaggacggcgttttacggcgcaccggataaacgtaacaataacgtaatgaaaatgataattatattcaaagagagctgcaaccttaacatatctggtcagatctcatgcgactacttgacgtacgtagacaacaacatttattgatacacaggatgttacggacataaaaaagccagccactgggggaggctggcaaactcgtagagcaaaatgctgttacgcaaacttcgttacagggtcatcctgcaatacaaaaaatacacaatatttagaaaactaatagtgccatgtgcaatttttaagattttgttattaattgtggtcgcaccttcctttctgtgtactttccgtatagctcacaggattctgggtacaaaaaaacccgcgcatcggcgggttaagcagcgtggcaatgtaaccactcttatcatgatatgcagatttttacgatcgtaaactattttttcgctgataaaatacagaggttctccctcccggcaattcacgctcaacataccgatccatctcaagcctcactcccagcatcatcagcatgccttcaacaatcccctccgctttgtgaaggcgtttacctatacaggtgtcagagcacccatgtttccgtgccagcgccatgaacgtcccccccagcacgtaataatcaaccagcaagtcatgcagatcgcgattgttccggtaaaggcgggctatacacccgcatatcaccatcgcatcatcgtcacagcactgcgggcgtgattttactttttcggggatcagtcccttaaatccggcggcaatgggtgaccaggtcacatcctcatggttatttgccgcccatgccccccagcactcaagaacctgccggatatcacgcatcagtatctttaccccatccgcgatgaaccataagaacaccgttgacaatagcgtgtctttttccttctttatcgccagtgtattttctgaccgtgttgcgactacagttcagtattctggctacctcggtctgattttcatatgcctcaacgagcatgtcaggaatggtttttactgtgaacgtcatgcggcctcacttctgctgtttcgcaggtctttaagtttctgctgatacttcgccttgatggccctgcactcttcgatagtccagcgatggcggttatggtttgattcgatttcgtctactgcttcctgcccgattcggttaatcagttcgacgcgatagggaacgagatttccgcttttatgctggttgcacaccacgcattgcttgtgaatattgcgttcatcaaatcggagttgaggtgccgcagcagttgtccggtaatgtccggcatcccactgagcagacatgagcgttccgcacgagatacatggtaagtcgcggtctctttctctgatgaaggcgtttacggcttgttgggcttgtttaatccagtaactgcggggctttaaggcgagttttcgaatcttcagtttatctttctgtttctgctcctctcgtcgtcgtttcttctctgctgctttttccgctttttttcgctgtttactttgtagtttgagtgctaactgagttccgtgttccgggcagcaccaccactgatttgagaatgccgggtgaaaccattccttgcatattttgcatttccttcgcgctggtttagccatcgtcttcttcctcgtacattgagctattcggatcgctcatcagttctgcacagcagtgctcacacacgtgaacttccagcacatgcagcttctgaccgcagttagcgcacgttaaagcccgctcgacgctttctttctggtattgaagggattgggatgggctaagcatggctttcaccattaaaaagtcgcttgtaagcatcaatgtctcgttttgcttcaccgagctttcgtcttaattccatgttttctgattcaagcttttccatgtcttgttggtatcgatcgcggtgttctttccatgctttttgatacgccttcatgtatgtcatattggcctttctctttgcctgacgaactgcgtggtggtttttcacaaaccagtcagggtcgttaaatgctgctctggcgcatgtataccaataatttgttgcctccctgtttagccaataaatactgataaatggcaaccggatagacaccatttttcgttgtgactctttctcgccaaacatgtggccttttttgatgctaagtccaaatccaggttgaattaaaagcattgtcatttcctcgcacgatgtcttagccaccggatatcccacaggtgagccgtgtaattgaaggtttttacgtcagattcttttgggattggcttgcgtttatttctggagcgtttcgttggaaggtatttgcagttttcgcagatgatgtcggtgatacttcgtcgctgtcgcctcatgcagccctcctgacgcccagcccgatcgccatcaatgccgctttggatacggtagtaaacatccgtcgaggactgatgaacggtcgccaaatcagcaacattgagcctttgctgtttcccttcttctccagccctgtcgatggttcgataaaattaatccgtccatcagtgatgatgcgaacttcgtcaacactctccagagccttgctgaaccatccgacagacatatcctctggcacaagcatcactaccgtctgtcgctgttgtatgcactgctcagcggctttttccacccacggcctgatattgctgtacggtgggttattccagattgcaccgtggcttatccactcagaatttagcgcgtcgtcagcctcagttagccagtgagcacacanagcgtttttgtcgctcgcagctgaatccagccagaatccaaactcaatatccagtgcatcaaaaagccaaagcggcgtttgccagcagtccttgtcgtgtgctggcgtatttgatttgatagtcatgcagccctaccttttcgttgtgaccattcatactctcgccgggagtcatcactccaccgcacgttgcgctctgagccgaaccaaaacatgatttcgataagctcagtcatgctggccttccgcattttgctggtacgcacgccaagcatgacaacgccaccgtcgataccaggcacacttcgttgctccagttttttggtcttaagccacagggcagtgaacaggtctttccagtcttccggcgccagccgttgaccatgccatagcacctgacgcgaaacatcgttcagcatcggccacatacggtcattctgcgctttgctgcgcctgggttctttaacgtggacttcgtggggtgacttgtcgtcgatgggtagtgagagaatggcgtctatggcgttatttctgattgcttcgttgcgaagcagaaaggtttgcttcatctcctgctctccggttccatttttcagccgccgcagcaactgatggtgcccatgcccccctggcttcacagaggtcacattctgcatagccccacacatcaatatttattccggcctcaacccacagacgagcattaccgccgcaaaacggacattcttttagctttggctgggttaatgataggtcgctcatgctcactccttcacttaaaatccagactccggataattctgttgcgctgaaactcattgttgagtttgaacaaccgtcgaagaacacggtcacgcggatagcgtcgtgcggcaggtgaatgctcatacaactcatcaagcggcaaactggacgatgaacgataccgataccaacgcaccaactcttcacgaaaattagccctgacaagctcagctatcgtactcatttcttaaaacctcctcaaacgcattctgacgcatttttcattctcgctgcttatcggcataccttgcacgtgcttacctcaccacagagcgattgtgatgccttaaaagcgatttattgaagtgatatttgcttaatcgaaattcttttctttgattcctgcggccctgatggctttcattactgcaattaccgttttgtcacgcccatcctcataacccatcgcataagcaccttcttcaccatctttccaaaggtcgtcattcgattcgggccagtcgatatccagttcaatagcagagcgcgatgcctgccatatcacccaggcaaactcttttaattcatcgtctcccgtgaactggcttttgtcttttgaccaccagttttcaaactgtcggtagctatcgttcacttccctctcccccaaataaaaaggcctgcgattaccagcaggcctgttattagctcagtgatgtagatggtcatcttttaactccatataccgccaatacccgtttcatcgctgcactctggcgacactccttaaaaatcaggttcgtgctcacctttccttcccgttcttccctggtagcaaaccggtaatacaccgttcgccagaccttaccttcgataaccagaagacctgcccgtgccattttagctgcggcctgatttatgctggttactgttgcgcctgttagcgcggcaacgtccggcgcacagaagctattatgcgtccccaggtaatgaataattgcctctttgcccgtcatacacttgctcctttcagtccgaacttagctttaatttctgcgatcttcgccagcgcctgaacacgatttagaggtctgccgcccatgacaggaagttgttttactggttcaggtatcgcctcaccacggttaattcgcgctgtcatacaggtcagttcatcggcagccttgcgtcgtaattccgcgtcagtcagcgcattggcccgcatgttctggtacaggttggtaaccagccagtagtgcgcgttcgatttccacggataagactctgcatccggatacaggcctcgcttccggcaatactcgtaaaccatatcaaccagctcgctgacgtttggcagtccggcgataacggatgcttcttcccggcaccatgcaacaaactgcccgggtgatggaagaaatggtcgattctgccgacgggctacgcgcattcctgcgttaacctgttccatcgaggtgatcccgttttcccggaaagccagaacccactggcggcggatttcgttcacttcgttctggtcacggttagccaggctcgccgggaaagttgccagtaactggctgaacacaccgttgatgatctgcgctacctgctgtacctgcggcttttcgtcgtactgttccggcatgttgttggcgatccgacgcatctgctcacggtcaaagttaaccatctgtgcggcgatgtttttcatagatccaccccgtaaatccagtctgtgtttgtcaggtcgagttttggtttgctggctgtcacgcctgcctgttgcttgttacggttgatttcgagttgggtccacttatcgcggagtttggccgggctcagcacgttaccggaccagaagttgtcctggcatgcccagcggaacagcacgcacatgtcgcggtggttacgtccgtcacgttcacgcatcaggcggatatcgttagcccaccctgcaaaattcggttttctggctgatggcgcgatggtcttcaccatgtcaaacatccactctgcggcggtcaggtcttctgctgtcccccacttgctgccgctctgaattgcagcatccggtttcaccacagaaaggtcgttttctggctggtcagaggattcgccagaattctcggacgaataatcttttcttttttcttttgtaatagtgtcttttgtgtccccctgttttgagggatagcaatcccctaatttgagggatgttttatccctcgttttaggggattttccctcgttttgagggatgtccctcattttaggggaacctccctcgttttgagggatgcaccattctgagatgtttttatttggtccaaacatgccgccttgcagcttgataatattcattctgacgagttctaacttggcttcattgcaccgtttgacaggtaactttgtaatctcgctaagttgagaatcggtgattctgtccattggtttattccacccataggttttacgcagaatggcaagcagcactttaaactgtcgcttggtcagatctgcgcctgaataagcctcaatcagcatatttgatagtctggcgtaaccatcatcgagatctgccacattacgctcctgttcggcaaagttacctctgccgaagttgagtatttttgctgtatttgtcataatgaatcctgtggattgatccagtaattccctcagaattgcatatcaatttgcttagagtccccggcggccaccggggattttttctttgtgattccatccaatgcatacttaaaagccctgctaatcggactgatgtctgatgccattccgaaagcacacaagaccgaagcaataaaccgccagtccgttctgcttatcttcgattcatgacagccaatcatctttgccagaccgcgctgggtaagcgttgacaggttgatgagtaaatcagtttcagcgcgatcaatttctcgctgtgttggcttgctgtagcttgcttgtgccatttgttaattttcctatattgatattgagttatagcggcacacccaatggatttgccgctgatgtttgctcacccggttagaggtgaaaggccatgatgaaagagcgggtactgcttaggcggctttgttactggatggagggaaaacatcatccaaagaacattggcaccctaacttcctgaggccttctacgatcattcggcaatcgttaaggccaggagtacggatattcagctcatagttggcgatgcgggattgcccccaaccaattgccgaagctagtacagcttgcgaaactccgattttttttcgctgctgggcaattttgttcattgcggtctccttagcattaatcacacacccattacacacaatttgtgattaacagtcaacctcaattcgtgtacagagttcaatcacgttgcgtgttacatttaagggatgaaaacgatgcatgaaattatcggggaaaggatcaagtcccttagagaagctaaaggacttagccaggctcaattggccaagctttgcggctgggctgcgccttcacgcctggggaactacgagttaggaacaagaaaggttagcgcggatgacgcgctggttcttggggcggcactcggcgtatctccggcaaaaataatgtttggcgaggattcagacgccgtatttcgccaatatgaatacccgttattttcttcagtgcaggccgggccattttcggaggtgggaagctacacagccagcgatgcaaaggcatgggtcccaacgaccacaaaagccagcgaaaaagctttctggcttgaggtgaaggggcattcaatgacggcgcctcagggggttcgtccaagttttccggaaggcatgctgatactcgttgatccggctgagccggtagagtctggggatttctgcgtggcttctgcaaatggtgattcagaggcaacgttcaagaagtatgagaaggatgcaggggttagttacctggtacctttaaacccggcatatagaaccctggattgcgaccatagctgccgcatcataggcaaggtagttaaggcgcagtggcctgaagagacgtttggctgatcggcaaggtgttctggtcggcgcatagctggtaatccaacttttccctgttctttttatgcaaattaatctaatgaaattgaaaagatttttacctattttgttggttcaggagaacataaatgagcgataaacaagaagtttccttagcacatatcaatgatgtgctggagtccaaaaattatattgaaactaatgctgaaggggttgtaacccatcggaacggataacaatggctacgaagtttttaacttcgtttttctcaatagcacccctgtcatcggccatatgaatggcgaaatcgcagtggcaggaatgcagcgcactaaggttgcgtccgtgactttaagtaaacagaaggccttcgatttctatcagtccttgaaaagcatgttcgaggaataaaagctgatgaatgcagctcaatcatctttggatgagggaaagctagtaattgcttactctgataagaatggctctacagtagggctggaattttcttctgtagcatcaagccaagcaacgctcttgatgaaagcttgttctgttgctgcttcagataaagaaaaacggattgtcacatcggttgtgatggatgatactgagatcattcaaacaacaagtgatgatggaggcgacgacatggataagcgattagcagttcttgaagctgaagttgcgcacatcaagagcagcatggcaggaattaaagaggatacccggaaaatatnttctgattctactgacgccaaaagagacaccgctgtacttttacagaagagcctggattttgatgcttcattatctaagaaaccatcggttgactactttgaagctaaattttccgctttggaaaccaagatagcagatgtaaaagtatggatgctcggggttctcttggcctcgcttgctatgccaactatatttttcctaataaacttgtaccttaagaaaggtcagtaatttagcaaatccggccaccgagccgggttttttattgcccgccgatcactatcaggacagcacctgcccgccggtccaaactattgattaaattactataattcttaatacaactcccatatcccgccatctcgccaccaccccattcgctcgtttttcgaacttttcagcacccatcctgctgttgccaccgacttaagtaagcaaaaccatcgcgggtaaaactatttacacaaaaaaatcatacacataacgtgtcacacctttattttacacattttgtgattgaccattaaatcacaatatgtgactatcatttccatcagcaggacgctgagacgccacaaggaacagattggcaggctctttaacatcgacgaactctcaacctaaccgttgagaccagaacttgagtggttttggggatggcgcgaattgcagctgcaagacagcgatcgagaagataaacacctcgacgcgtcatgcgccaaagccacttaaaggagaccatcatggtaaccattgtctggaaagaatccaaaggtacggcaaaaagccgctacaaagctcgcagagcagaacttattgccgagcgacgcagtaatgaagcactggcgcgaaaaattgcgctaaagctctctggttgcgtcagagcagacaaagcagcatcactcggaagccttcgctgcaagaaggcagatgaatgcagtggaagtatttgcctgccaaacgtagccatttacgcggcaggctaccggaaatcaaaacaactgacggcgagatgataaattaatttgctaattacttgtttttgccatgcttatcctgagcgataagttcatccataagactgtctttcttcccagcaaacctaatgtagcactcatttctatagcgttccgggataacaaacggtcgatttcaggatatccagtagcagaaaggtacccgaataagaagccctttttcgagcaatgagattgcttcagggcttcccttttctgtctttagctggttattagcggctacagcgaatgccaaatacgctctttctccaagagttaacgaatcaaacaaatcttgcacgtatttctcttctttagatttgcgcttctgagcagcgaatatctcaattctttcagtcacagcgtgataagcggaattaacaacgccgttaagcacatagctaacgcaaaacaacaggatgtaatacatccagtaatgaggaaggatttctggattatgcaggtttatccattcttttacgcttacaggcataacaataatcaatataatcaggatgattagcatatgaatcaacggtttaagtgtcattccttgcaggaaaaaatgcattagttcctgccaccatgagttgttcatcggcgtttctcttttgctctctgtaggggtgaatagagtttatccgatttctcgctgtaggggtacacgagaaccaccgagcctgatgtggttaaaagacaggcatactaataaacactgcactgtgtattcattccaacgagtgaatacactgagcaatgtcgctcgtaactaaacaggagccgacttgttctgattattggaaatcttctttgccctccaatgtgagggcgattttttatctgtgaggatatgaacagatgtcaaacatcaaaaaatacatcattgattacgactggaaagcatcaatagaaattgaaatcgaccatgacgtaatgacagaggaaaaacttcaccagattaataatttctggtcagactctgaataccgactcaataaacacggctctgtattaaatgctgtattaatcatgctggcgcaacatgctctgcttatagcaatttcaagcgacttaaatgcatatggtgttgtgtgtgagttcgactggaatgatggaaatggtcaggaaggatggccttcaatggatggtagcgaaggaataagaattaccgatatcgatacatcaggaatatttgattcagatgatatgactatcaaggccgcctgagtgcggctttaccgcataccaataacgcttcactcgaggcgtttttcgttatgtataaataaggagcacaccatgcaatatgccattgcagggtggcctgttgctggctgcccttccgaatctttacttgaacgaatcacccgtaaattacgtgacggatggaaacgccttatcgacatacttaatcagccaggagtcccaaagaatggatcaaacacttatggctatccagactaaattcactatcgccacttttattggcgatgaaaagatgtttcgtgaagctgtcgacgcttataaaaaatggatattaatgctgaaacggagatcaagcaaaagcattcactaaccccatttcctgttttcctaatcagcctggcatttcgcgggcgatattttcacagccattttcaggagttcagccatgaacgcttattacattcaggattgtcttgaggctcagagctgggcgcgttactaccagcagatcgcccgtgaagagaaagaggcagaactggcagacgacatggaaaaaggcctgccccagcacctgtttgaatcgctatgcatcgatcatttgcaacgccacggggccagcaaaaaagccattacccgtgcgtttgatgacgatgttgagtttcaggagcgcatggcagaacacatccggtacatggttgaaaccattgctcaccaccaggttgatattgattcagaggtataaaacggatgagtacagcactcgcaacgctggcagggaagctggctgaacgtgtcggcatggattctgtcgacccacaggaactgatcaccactcttcgccagacggcatttaaaggtgatgccagcgatgcgcagttcatcgcattgttgatcgtcgccaaccagtacggccttaatccgtggacgaaagaaatttacgccttccctgataagcagaacggcatcgttccggtggtgggcgttgatggctggtcccgcatcatcaacgaaaaccagcagtttgatggcatggactttgagcaggacaatgaatcctgcacatgccggatttaccgcaaggaccgtaatcatccgatctgcgttaccgagtggatggatgaatgccgccgcgaaccattcaaaacccgcgaaggcagagaaatcacggggccgtggcagtcgcatcccaaacggatgttacgtcataaagccatgattcagtgtgcccgtctcgccttcggatttgctggtatctatgacaaggatgaagccgagcgcattgtcgaaaataccgcatacactgcagaacgtcagccggaacgcgacatcactccggttaacgatgaaaccatgcaggaaattaacactntgctgatcgccctggataaaacatgggatgacgacttattgccgctctgttcccagatatttcgccgcgacattcgtgcatcgtcagaactgacacaggccgaagcagtaaaagctcttggattcctgaaacaaaaagccactgaacagaaggtggcagcatgacaccggacattatcctgcagcgtactgggatcgacgtgagagctgtcgaacagggagatgatgcgtggcacaaattacggctcggcgtcatcacagcttcagaaattcacaacgtaatagcaaaaccccgatcaggaaagaagtggcctgacatgaaaatgtcctacttccacaccctgctggctgaggtttgcaccggtgtggctccggaagttaacgctaaggctctggcctggggaaaacagtacgagaacgacgccagaaccctctttgagttcacttccggcgtgaatgttactgaatccccgatcatctatcgcgacgaaagtatgcgcaccgcctgctctcccgatggtttatgcagtgacggcaacggccttgagctgaaatgcccgtttacctcccgggatttcatgaagttccggctcggtggtttcgaggccataaaatcggcttacatggcccaggtgcagtacagcatgtgggtgacacgaaaagatgcctggtactttgccaactatgacccgcgcatgaagcgtgaaggcctgcattatgtcgtgattgagcggaatgaaaagtacatggcaagttttgacgagatggtgccggagttcatcgaaaaaatggacgaggcactggctgaaattggttttgtatatggggagcaatggtaatgaagcatcctcacgataatatccgggtaggcacgatcactttcgtctactccgttacaaagcgaggctgggtatttcccggcctttctgttatccgaaatccactgaaagcacagcggctggctgaagagataaataataaacgaggggctgtatgcacaaagcatctcctgttgaattaagaacgagtatcgggatggcacatagcctcgctcaaattggagtcaggtttgtgccaataccagtagaaacagacgaagaatttcatacgttagccacatccctttcacaaaagctggaaatgatggcggcgaaagcagaagcaaacgagagagacccggcatgacaacaacagaatgcatttttctggcagcaggcttcatattctgtgtgcttatgcttgccgacatgggacttgttcaatgacacctcagcaggaaaacgcccttcgcagcattgcccgtcaggctaattctgaaatcaaaaaagccagacagcagtttccggataaaaacgtcgatgacatttgccgtagcgtactgaagaagcaccgcgaaacggtaacgctaatgggattcacaccgactcatttaagtctggcgatcggcatgttaaacggcgtctttaaggagcgatgaacatgaaaagcaaaatcatcagggagctacaggctccttttttattgttcgcattcaccctcaagcgtattaaccaacaattcagggattaatggaagatggcagacatcattgattcagcatcagaaattgaagaattacagcgcaatacagcaataaaaatgcgtcgcctgaactaccagactgtatccgcaactcattgttgtgagtgtggcgatccgatagatgaacgaagacgcctggcagttcagggttgtcggacttgtgcaagttgccaggaggatctggagcttatcagtaaacagagaggttcgaagtgagcgaaattaattatcaggcactgcgtgaaaaggcagagaaagcaactaaaggaagctacatcgtagggcatacatctgttaaccagcacggcaatttaacaggagtttttgtttgccaaaaatggaaaggagaacccggtggtgtgattgcggaatgtcatgttaactgcctggttgaaacagatgttcaggcttatgcaaacgctgaatttattgctgcctttaatccaaatgttgcgctggcgcttctggatgaacgggaaagaaaccagcaatacatcaaacgccgcgaccaggagaacgaggagattgcgcttacggttgggaagctgcgtgttgagcttgaagcagcaaaatcaaaactcaacgagcagcgtgaatattacgagggagtaatcgcggatggaagtaagcgcatagcagaactggaaaaacaatgcgccgaatgggagcgaaaagcattaagcaactttgaagagtgtgctgcgatggctgaacgtatcgaagagatgcagacaaaatctgcaccagattcgtttggcatcatcggtgaaaatattcgaacacaggacaatcgaataacgtcagatcccatgttttgtgtgtatcaaaagcgcgaaatcgctgttgatgctgattatgaccatgaccggattgtctgggttgacgaagatggcaatgaagccaataaacgccatagtcgtcgtctcgagctacttcatgaaaactttcgagagccaccagaaaaatggcggcgcgttgctgtgaaagatattgatgaattcgttacctgctgtttcaccgaacagggttgtaaagactacctggcagtcaatggtcacaatcttcgcttgccatttatatatgtaaaaagcggtttcaggaacgctgaatatatcggcataagaaactggcttgctggcattcgcatcaaaggagagtgatatggcgttaacacaccgcgaactctgtcagattgcgtacaagttccttaagcgcaacggtttcaaggtttgttttcatgaccgctttatagctgtaaccagtaccggagaacagccagatgctatgggattcagaaattcagcatcatgcctgattggcgaaatgttctcgtgctgacttgttggcagatagaaaaaagcgttttcgtaaaaatccgtctcttggaatgggcgactggcgattctttattagtgagccgggaattatttcaattgaggatttaccacctggctggggattacttcacgttgttaacggaagagtacggaaagtacatgggtggcccaagggtaattgctgttggggtaatcctgacgataagccatttactggaaataagcaggttgaatgcgattacatgttgtctgcattaaggcgcatggagttgagagggcaccttaatgaaatatatgacggtgtaattgttaataagaaagaaggaaacgcggcatgaccactattaccgacaaagaactgattaaagaaatcaaagagcgcataggcagcttggacgttcgagacaatattgagcgccgtgcttatgaaattgcactggcatcgctggaagcagaaccgatagcgtgggaatgcggtgaaaacataatcctgtttaaccctgacacagttgaagcatacgcaaaacgtgcggaaatatcacctaaaccactattttccgcgccgccagcgctggtagtgcctgataagttgccgcgtgaatacagaaacggttggcctcttgcgtatagtgattatgctgaaggctggaacgactgccgcgaagccatgcttcagggagataaatcatgattaatcgtatcaagctggagcacatcctcgaatatgccaggcagcagaggcatattggtcagcattgtaaaattccaccaggagatatggttgaaatcatggagattgccatgcgcaaggctggcaactctccggtaactccggatggttggataagctgtagtgagcgaatgccgaacgataaacagtatgtttggtgttgggggaagtcttacggctggactgagtgcgataccttcgaagggtattacgattgttcgagaaacaaatggtgggcagttactgacaatggggaagaaccggcatcgaaagtaacccactggatgccgctaccggagccgccgcaggaggtgaaatgatgaattggcctgaagcattcaccgcagttggagttgcaatagcggtggcatttattctgtattcgcttttccgctggggataaaggaatgttcgctctgattcaacgtggtcagatatacacggacagagccggataccctgtggtgattactcgcagtactcagcactcagtgttctttcgacgcatggacgggcgctccggacgggtacgcattggtgagttcaacaacctgttcgaacatattgaccaacaggagtaccgcaaaattctggcgggcactgagcaggaaatgcgcctgaaaaaattacgcgcaatgcaacggaggtgatacatgcatacggcttttgagttctgggttcgcaagacattcggcaatcgctacgacctgacccgtgatgtcgacggcttctactgccgtgaagttgtgaaacgaatgtttgacgtgtggtgccactgccgtggatgaaagttttatgaggttggcatgcagacaatcatctatcagataacccccagcaaatggtgtacggagagagtccttattgcatcaacagggctaaagcccggcaccatcgagcgggccagaagaaagtcatggatgcagggaaaagaataccgccattacgctgtagaaggtgatcctgggcattacagtgaatgcctgtacaacatcgaagaaattatgcgatggatcgaaaaccagaaacaaccaggtgccaaaaatgcaagttccggttaacctgttaatgctcctggacgtctgggaggtttaatgagtaacgcatcatacccgacaggcgttgaaaaccatggcggatcactccgtatatggtttcactataatggcaaacgtgtcagagaaaacctcggtgttcctgacacagccaaaaaccggaagatcgctggtgaacttcgcacttccgtttgttttgcaatcagaatggggagtttcgactacgccgcgcagttccctaattcccctaacctgaaacactttggtctgggaaaaagagagataaccgttaaggcactttcggaaaaatggttggaccttaagaaaattgagatttgtgcgaatgcacttaaccgttaccagtcagtaattaaaaacatgttaccaatgttaggtgaaaaaaaactggtttcatccataacaaaagaggatttacttttcgtaaggagagatttgttgaccggttaccaaaagctttctaatggaaagacttcttccataaaagggcgctcagtggtcacggtaaactactatatgacaaccatagctggaatgtttcaatttgcaacagataatggttatacctcaggaaacccatttaacggtctggctcccttaaaaaagtccaaggtaaaaccagatcctctcacccgtgacgaatttattcgttttattgaggcttgccgtcatcaacaaacaaaaaacctgtggattctcgctgtatacacgggtattcgtcacggggagttggtatcgctggcatgggaagatatagaccttaaagcaaggactataaccatccgtagaaattatacaaaacttggcgaattcactccaccaaaaaccgatgcaggcaccggaaggacaattcatctggttcaaccagctattgatgctcttaaaagccaggcggaaatgaccatgcttggaaagcaacattctgtagaggtgaagcagagggaatatgggagaactgctgtgcataaatgcacttttgtttttagtcctcaggtaacaaaacagcagcagttgtccggacctcactacaaggttgactccatcagggagtcatggacaagtatcttaaaacgcgcaggtctgagacacagaaaatcgtaccaatccaggcatacttatgcatgctggtcacttgccgcaggagctaatcctagttttatcgcaagccagatgggccacacaaacgcacaaatggtattcaatgtttacggagcatggatgaaagacaacaatcacgaacagatagaactccttaacaaaagactatctgaaagtgtcccatgtatgccccataagaaagcagggtaaaataaaaacttgcaaaatcaattagtttacccttaatcc

SEQ ID NO: 138 - DNA  (genomic), 41 bp; double-stranded, linear
aaagggcgaaaattcagcaagttaagatatgaacatcaggc

SEQ ID NO: 139 - DNA  (genomic), 377 bp; double-stranded, linear
taagttgtcaggtcaggaactagatattttgtgtacttgatttgcaaacagctccggtgttggtggcgtcaaaatcgctgaagcgttccccgaaggccggggcagcccacatggatgtgggctgagggcgcgtcttacaaggacgtttcctcgcgcccgacccggtagccgaaggggataagctgaaggtaccgcgcagcggcgattttgttcgccagaacccgggggtgcagggggagaggcgattgtcctccccctgcgcgctccttgcgccagtggcaatatgtggcttagctcatgaaaggagcgcaacaagatgatgaagctgaataagcgattcattgtttctgataaactgcgattccactattatcgca

SEQ ID NO: 140 - DNA  (genomic), 6185 bp; double-stranded, linear
ctgtgtttgcagacaaactgacttactgattaattcgggcaagatttttaccctcaccctaaccctctcccgaaggggcgaggggaccgcccgtgcgcctgattgggtgaagaagtgcttagcgtggttgcaaacagttatcttctttccagccgtacaaccactccatgccgcgataaaattctgcctgcgatttccctttccacagcagattacgtacctggcgttctacccctgcggcgtggtaaacccgccccatttcacgggtcgaccagacgatgcgcgcggtgcgcggaattcgtaccgactcatacagcgcaaaggcttgcgccgcatcaccctcacactgcgccagcgccttacccagcgttactgcatcttccagcgccatacaggctccctgcgccatatattgcgccaccggatgggccgaatcgcccacaagcgttatgcgcttcgttccccacttcgccaccggttcacggtcagcggttgaccagcgtcgccatgaagtcggtttatccaacatctggcgcggacgggggtgaatcccttcaaagtaagagagcacttcctctttactaccatccttcacgccccactcttcctgctggcggctgtggaatgttaccaccaggttatactgcttgccgccgcgcaaagggtaatgcaccaagtgacaatgcggccccgcccacagtaccggtgcgttaatgcgcaaatcttccggcatatcggcacgatcgataaccgcacggtagacaacatgtccggtgacacgcggcgcatcgcccaataagctctggcgcaccactgacttcacgccgtcacagccaatcagaatatcgccggtccagctattgccgcgatcgtcaaacacggtgacatcgtcttccgtctcgcgaatatccacgacgttggtggaggtgtgatattccacgtccggatgcgtcagtaccgcttcccacaccgaggcgtgaatatcaacccggtggatcaccgcgtaagggccgccgaaatggtcacgaaaggcctgcccggtttcaatgcacaccacttcttcggcgttcaccgcatccatcatggtaatgtgatcggtaaacaccgcgcgctggcgggcaacttcgccgacgccgaggctgtccagcgccgaaaacgcatttggccccaactggatgcccgcgccaatctcaccgatctcatgcgccttttccagcagcaccactttgatccccaggcgggccagtgacagcgcagttgccgcaccgccgatcccgcctcccacaattactgcgcgtgtcactttcgtcattatagttctcctggtcaggctgaaattttatcttgttgattttctggcgctgcggcaatgaacgctggcagctgtgtgcaggcgtcgtacaccgctttgcagcgtggatacccgctcaaatcgcagttcatgcgtagcgcgttcgcccactgcgggacaaggcagcaatctgccagcgtcggcgtctcgcccacacaaaattgccccgactggttctggcgcaacagttgttccaccgcgcttaacccttgctggatccagtgcgcataccaacgttttttttcttcttcactgacgttcagttcttcggtcaggtagcgcagcacgcgcaagttattcaatggatgaatatcacaagcgatggcatagacaatttccagcaccttgttgcgggccggctcttcctgcggcaccagcggaacttgcgggtagtgcctctccagccagtcaataatcgccagcgattgtccgagtgattcgccctcgtcagtcagcagcgtcggcaccagcccgaccggattcatccgccgataggccagttcattttgctgaccaatacggatattcaccccttcggtctggtaattaatgcctttcagcgccagcgcaatgcgtacccggtacgacgctgaactattaaaaaaactgtacagcttcatcatgcacctcagacaatcttcaccgcgataggcgttaagccctcgacgttgcctgtgatcacatcacctttcactaccgggccaaccccttccggcgtaccggtgaagatcagatcgcccggttgcagctcaaagaagcctgacagatagcagatggtttcattcaccgaccagatgagatggcgaatatcgctgcgctgatgatcttcgccgttaacctgtaaccagattggcgcattatcaataccgccgatatcgcgggctttgtgcagcggcgcgatgggcgctgagagatcaaacgctttaccgatttcccacgggcggcccatctggcgcatttccatttgacggtcacgccgagtcatatcaagacccgtggcataaccccagacatattcatgggcgtgttccagcgggatatcgctgccttttttaccaatcgccaccaccagttcaatttcgtaatggtagttatcggtctgtgccggatacggcagcgccagcgtttcaccagcggcaaccggaacaacggcatccgccggtttgcagaagaagaatggcggttcacgatccggatcaaagcccatttcgcgggcgtgagcggcatagttacgtccgacgcagtaaacgcggcgcacggggaattgttcatcactgccaacaaccggtacggtaacgggcgcttgcggttcgaatacgtattgagtcatttttctctcctaaattaataacgcgcttcgcggaacagccccagggcttcttgtaccggtctgtccgaaaaactaaataaaacggaatcttgcgtggtctggaacgacacgccatgccaggtcggcaccacgaagatatcttttgcactaaagctgaaggtttcattgccgatgatgacctgcccgctaccttccaccacatggtagatggtgctgtcagtggtacgcgcaacgcgtgaggcaaaccctttcggcagcagttgcaggaaagcgcccatcgacggcatcggatagccgccggtgaccgggttgacgtagcgcattttgtagccatcccactcgtcggcatcgcccagtcgggttaaatcgtgcagcacttcgcggctgcggtcataacgatagttaaagatcggcgaggagttccccgtctgatgccgcagcggcaacatattggcagcgtaacgcggcagataatctccctctttacgcgttaccggttgttgctcttccggataatcttcggcaaaaccgcagcccagaatattcactaatggcagatccagcccatcgagccagataaccggttcgtcgccagggttaccgtgatcgtgccagcgccactgcggggtcaggataaaatcgccttcattcattggcgtgcgttcgccatcaacggcggtaaatgcccctttgccttcaacaataaaacgcagcgccgactgattatgacgatgactcggtgccacttcgcccggcatgatcagttgcaaaccggcatataaagtcgcggtaatggaagactgcccgcgcagcgccgggttttccagcaccagcacgcggcgcacggcctctttcgcaccaatcaggccgccgctctccagtagcagcgggcggatctcctgataattccagtacgctggcgcacagttagcgttgggcgttttcggcaccagatggtgcagtgactcccacagcggggtcaggttttgcccggaaatatgctgataaaattgctcgcggctattttgattgttatcagtcattgagatgctccttattcgttcacaacgcctgcgcgaggcagtgagtcagggacagaggtcgactggcgaaccacggtaatcagcagggttaacatcaccgcactgatcgccgcaggcacagcgataatgaaaaacagggtgtcgaaagagaaattcatcgccatcatcacgccgccagacagcgaaccaacaatcgcgccgcagcggccgatagcatttgaccagctcacgcccgtggctcgactttgtgttggataaagtgttgcggtcagcgcattcagccccacctgcgatccgctaatgccaatgccagtgccgaaaatcgccagcgccatcaaccataatccatcctggcttaagccaatcatcacgatgcatatagcgcctatggcatagctcagcgtcagcacgcggaaaggattgaacttatccatcagcacacccagcgccagcgcgcctaacgtaccaccaatctggaacgcggcggtgacccaggacgcgtgttgcaggtcgatgccgcgatggttcagtagcgtcggcatccagcttgagagcaggtaaataatcagcaggctcataaagaacactacccacagcatcaacgtgatgggtaactgacgtcccataaacagttgacgaatgctgccttttgtaacggaggctgattcaatgagataaaagtgggtatcgacataacgctcgcgggtgatggcgctgacggttttcgcaatcaccgcctgcggtagctggcggcgcacctgccagcgtggcgattccggcagaactaccagcagtgcgacaaacagcatcagcggtaacacgccccccaacaccagaatgccgtgccagccaatcaccggcaccagctgcgcactgacaatcccgccaaacgccgaacccagcgtaaagccgcaaaacatcagcgtcaccagcgcgccgcggcggcgggcaggcagatactccgaggtcatggtgatggtgttcggcatcgcgccgcccagacccaggccggtgagaaagcgcaggaagaccagcgtttgcagatccggtgagaaagccgaggcgaggcttaacgcgccaaacaaaaagacgcacagctcaatcacccgcttgcgaccaaagcgatcggacaacgggccacaaagcagtgcgcctgcggttaatcctagcagacccgcgccaaaaagcggggagagatcgcctgcggtgagttgccagtgagtgcgaatatcaggggcgataaatccgatagccgcggtgtcaaaaccatcgagcattaccaccagaaaacagcagatgataacgcgccactgcatcttgccgaccggagcagcatcgataagtgcttgtaaatcacgtcgttgagtcatagtaaatgcctcagtgcaggtaaggtagatgtttcttttgttttgtatatgttgcgatattgtgattaaagagatgagatgtacaatggcatttcgggcagagagataaccttgaggttatggcaaatggcgaactgggcgcaaaaattaaaactacatcaccttgaaatgctggtggcgctgggtgaacagggcaatctaacccatgtcgcacgaatgatgaatatcacccaacctgcgctttcgaaatggttgtcacaactcgaagatgagattggaatcacactttttgagcggcacagcaaaggattacgtccgactgaaggcggcaaattgttattgcaacatgcccaacggttaatcaatgacatggagcgatcgcaacatgaactggcccgttttaaacaaggtggactggtcggcagtctgaaaattggctgttctcccgtcgccactgactgcgtatcccaggcgattttgcatttgcttacgaagatgccaactctacacctgaatatcgaagagaaggtgatgaccccattgctgcaagatctattggccggttctgtcgatgtggtcgttgggcgaattggcggtcgcgcattgcagctgccactgaattatcaggtgctgtacaccgagccagtatgctttgtcgcccgccctgagcacccactggcgaaatacgccaccctcagctggaatgatcttgccaactggcgctggatcgtctggccgacgggtacccccattcgcattagtattgataatgcgctggtagaccacggcgtaatgctgccagaaaacacgattgagtcggcgtcgatgaacgtcagtaccaacctgttacaaagcagcgatatgatctctattttgtcattacgcctggcgcaacgttatgccagccagggacaactggtgatactcaacctgccaaagatagaacagaaaggtagcgtcggtgtgttctggcgcaataacgaaacgccttcttatgctttaagtcagtttctgcactttttacagcagaattagtgtgctgaacggggcgctcgcccgaggttacctccctaaaattcaactatgctgag

SEQ ID NO: 141 - DNA  (genomic), 150 bp; double-stranded, linear
ggaaagccggagtaaatggacagttctcagtacgaaaaataagaaatgaccaatctgccgacgcttgttaatggttatatcctggcgtcggcagatcgcccagcagtcttatctgaaaaaagaaagagccaggttgtgtgaagggatgga

SEQ ID NO: 142 - DNA  (genomic), 1879 bp; double-stranded, linear
cattcggtagccagtatgtgcaaccatcatccccatcacacaggctcccagcgccaggcctgcatccatcgcattgaagaagagggagtttgcgacaccgattttatgcggttccactgaactgataatctgcgtctgaaaaactggcgtcacggaaccatacccgataccaatcaacgcgccagaaacgaccatcattacgctgccctgggtgtagccgagaaccaccagcccaaccgtaaagaacagcaggcaggggtaaaccacatatttcgggccttttttgtcgcaaacattgccggtgaaggtacggcagatcatcaggaagatggcgtagcagagcaggaaattactggccgccgacatcagattaagttcgcgggcgtaaagcgccagaaaggcagaaaccccggcatacgaaaaggtcataaagaatgtaaccatggcaaacggcaatgccgcgcgatcgaacatggcggcgaagcccatctttggctttgaaccgtcggcatggctgataaccggcggcacggtcataatcagcgacaggataatccccaccgccgcaacgccagtacataaccagaaagccatattaaaggcctcccagcgcgccatattcaggccaatccacggcccgaccaccattgccagccccattgccagagagaaaaaactgatgccctccccacgtcgggaggccgggatcagccgcgcggaaatcgttccctttaccgttgtgataaccccgaaggtaataccatgaagcaccctaataaaaagcagtgattctattgagtggcaaaaaggatacagcgcagtgaccaccaaaaaggccagagaagagagcaccagaatagttttattcgaatatttacccacccattgcccggcaaagggtcgaataacaatcgccgcaattaaaaataaagtcaccaacaaacctgctttatcaggagaggcatgcaagcggtcagagatataaattggcaacaatgttagtaaaacataaaagacgaagaaaataataaagctgatgatggttattgcccaaaaatccttcgtccataacttctctttcatactctaccgcctgtcaggatgacgcacgcagacaacactcccgttactgcggttgcgtcaaattgtgatgtactttgcagaacagaagtataaatggcggcatgctattagagaaattaatcgttttaatattattgattagcaaactctaatgactcttacccaaataaattctttactcgccgtgctggattacggtggctttactgaagccagcaagcgattgttcatgacgcagtcggcggtaagtcaggcaattgctgccctcgaacaagaacttggtgtgaatatactgttacgcgatcgccgtaaagctatacaactgaccacagcaggtcaccgcattgtgcaacatctgcgcgccattaatcgggaagttaacgcagtaaaagagatagccgagcaggaaaagcagaaccctcaaagaacgctgagacttggttgtttccccagcgtctgcgcctgtatcttaccggttgtgattcgctactttgaaattcatcatccgaatataaaaattattccttttgaggaaaatagcacagcgattattgattcgcttcagaatgaatccattgatgccggttttgttcattttccggtgagcggaatgtactccgtgcccatttatcaggataaattcaccgtagtgttaccgcccaaccatgctctggcaaaaaacagcactattacagtggaagaattaatgggtgaaccattaatcattagtaaaggacgctatgaattaagcattatggcactatttaaagaaaagaatattaccccacagataaaa

SEQ ID NO: 143 - DNA  (genomic), 1713 bp; double-stranded, linear
tgagattgatgacaaatgcaagactgcctgattcgccacacttagttgtactatagcctttaccaggcgtaataattcgttttcacctgattttggcccactttgtgaattggcgatatatttatccagttgggagaagtgacaatgactccaggtagaaaccggtatgaagcgcccgactcactgtcaaaaccgattgttgagagtaatgacactccggcgaacagtacacagtttactctggagccattctcaatcttcaagtgggatacctaataacttgtcagggaagttatcaatatctgtttgttacttattaccgtatttattaacaataatgatactttctaacatgcgtaaaggtcttcgtaataaaatgagctaaatttgatagtgaatatattctgcaaagattaaattgtatcttgttaactcacaatacaaggaatcatttatgccaaatacatctattcacttatctcgctgtaatattttacaaaataataaattgcaaccaacagaaatttacaaagaatcacaacaaaccgccaaacttgagtttttttgcgatgagtttctaaaaatatctcaaagtagatacgggttatcaacctcaacagacagcatagctaatttattggcttttttcacgaaagcctcagatgcaattgatagtatcaagacccaaaaaattgacgttcacagttatggtttcgtaccaataagacattttgtcgaacatgtcataacgtataaaaatgaatttgcagcggattatgaaccctatacccttacctttacccgaggtgaaaacaacgaaggtattttgagtgtcgaaagcaaagaagggtttatttcacaaagaacaataaacttaaatgaatatgaaactgcaattaacatcatcaatgaacatgttataaaagaaaatatccacaacacggtccagtcaccgacagaaaaatacatttcaaaaataaacagctctgataaaccttataaaaccagcagtaaggaaagtattaaaagtcaactttacagcgatcaaagaaatatacagacctgctactacattctgagaaaaaatacagaatggtacaaatacgcatcctccgaggaacgctatgataaattcaagaattcttctaaggaaattaaaaatacctacaagcaaattgtacaagcgcagaaaaaattgaaccaaatgaaatacatcaataaattaagtggtgagcttatcgatatcaccgacaaaaagttagcaccattaataaatgatagtttcagctatacacgagatttctttgcttactcaaaacaggaaaaaaatatcttcacatttgataattctaagtttgtagatccaaaggaaaaagaaggtttaatggtacaacacagcaatgggcaactggttattactggtaaatattgccctgaaggtgtgcaaacagcattcacccaagaacaatatgataaattaataagatacattaatattttctttacctttccgaaattagaataatactttacagtataaactgcattacaatttattattgagacctattcatactgtttaaagaataacaatgcccagtgttagcttttttaacgaatgagttttacgaaaattatgttggcatcttttttacaggacgcaccggttaatgaaaagaataaccggtagtagcattatttcgctttagcaga

SEQ ID NO: 144 - DNA  (genomic), 36 bp; double-stranded, linear
gtttcaattgtgaccccacgagagaaacgccgaata

SEQ ID NO: 145 - DNA  (genomic), 207 bp; double-stranded, linear
ttactcctgctcaggctatctcactcgccagcccgaatcccggcagtgctcgcaatcctcacgtacttaagtacgctccggttgctgtgcgctggcggtatccggtctgacttcgccgatgacgcctgtacttcaggaacagttacctaaaatttattcttagttcacagacccggcgcaacgccgggtatattcactcagccaaca

SEQ ID NO: 146 - DNA  (genomic), 182 bp; double-stranded, linear
cttatccgacctacggttctacccctgcgtaggcctgataagacgcaccagcgtcgcatcaggcaacgcctgtcggatgcggcgtgaatgccttatccgacctacggttctacccctgcgtaggcctgataagacgcgccagcgtcgcatcaggcaacggctgtcggatgcggcgtaaacgc

SEQ ID NO: 147 - DNA  (genomic), 7198 bp; double-stranded, linear
tattagggggcggatgcgttttgccatttcgccctgaatgctggtatcgaatgccggatgcggcgtaaacgcctgatccggcttatcaaaatgtgcaaattcaatacgttgtgattcagttgtaggcatgataagacgcgtcagcgtcgcatcaggcatcaacgcacaactacagttcattcagtacatactggaaacggcatgtagaatcaattggctcacggctactggtattcacctgtaccacaatgtcgtgtagctttctatccgtcaatggttgacgtgagggggtgactgtcacctttgcattatcacaaccatacgaggtaaaggttaataagtcagaaacagcacgacaatatgcccctctggaatcaaaaatactgccatcgcagagtttgccgctttccatcaggtaggtcgaaagcgtagtcgtgattgtcgaaccatcggattgcaatcgcagcgctttattatggctaacataattatcactccaggatatatcaaacgaagcgacgggaattgtcgggcaaatagaatcatgaactgttgggcttgtatacgtaccaaatccaaatgcctcagatactgaataaaatgaggcaatccacggacaaccataattatcagattctacagtgacgttaaaagtcatatatgcacagacaaagacacgagtattgataccagggcaatttgaggtgtccgtacgtctataatcagtcaaaaccagtgtcggtgccgggccagatccgctccaggatattaacttgagggtgtcgccttttcttgcattggagttgtattgtccgtagcttacttctcccggcgtcactaccgtgacatagaaatataaactgccggaagcagtaacgtttttcatcgcataataaattttagtactggaaaagcttgcactcatgagtttatcaccggcatagcactttggtgtttctaaactgagagcaagtaatatcagacttgtcaaaaatatcgtccattttttcattttaaaaatactcaaaagttaccgtcattgtggcggtgaaatcacccgatgtaacatttcgtccatttacggtctgtaaccaggcattaaaattgacactgttatttccctgatttaatggaaatgaggcacctgtggtactgttaataggtacagccgcccctccggcagtttcaatgccaatcccaacacccgttgcagaagatgacgaatcaatcgacagaaatcctggtaagtcggtatcttctgttcccatcaaggtcaccttgacattaaacgccgtggtgcttttgcaatctttcaactgaaaaactaacggtacgcgatctgactgaccacgttgcattaaatcgctggcagcaattgtggggaaatgaatttctgcaagtaagttgccattgattacaggagtacaggatttaccaagcaaattaccggtaaaatgcaggttatcggcagctggggccgttccgctgaacaatatcagaccactgataagcgcccacgcacggttattcttcattggtaatccacctgtaacgtagcccatgcttcaaagtctgactcgggtaagtcgacaccgctcttttttacgggtactgccgttagtaccggaagggatgtttcattcaccactaagggcgtatgcagcttaaaatcgctcccggcttgtttgaggtgtattcctaatccattgagatccgtggctacggccgaatcgtcaaagtcactctgcgtaccactccaggtcaacgtcatttccatttgagggtcacggacagcggtatcgcaggtaatggtatacggcacgacctgttcgtaattgctaccgttaatgtcatcaatattcacgtcccgaaacgtcaactctatattttgcccattactaatagagcaattgggtggctgcactaaataaccatgaaaagagacattcgagagcgccataaagctaaagctccacaacattaagagagagatccgtttcattgataatccaccacaattgtggcactggcgctaaattccgccgccgttagcgatacaccgctctgcacgacaggaaccgcttccagagccagtgcgccagatgaaaagttaaacggtaaccatgcgccaggcgttaaatccaaaatggagtgatcgcttactttctgaatacggataccaaaaccggcaatacccgtatcgattaccgtttctccgttaattacggttgtggttgcctgcatatttaagcgcaggtcgtccattgccagattgttgcacacaagcgagtagtcaatggggcgtttgtaacttaccccatcgatcttggaaatgaagacattaccaaactccacgctcgcacccgttaccgtacagggcggcggggcatcaacgagcacacgcaagaccatcgcaaccgatttactccccgccattacaggcgtgctcacaatgctacacagcaataaccacgcccaggccgaataagctcctttcatgctattgctcctatccctggcctttgctgttttgctcttcgtccacctgacaggtatttcccgtacagcggaagaacagcggcaaacgcgcaccataatcattcacataggtcagcaccgggacgctatccattttgacttttaacggcacagaggtttttggcgatatcaccatgggggaaaatcccgctgccggattgccatttttctgcgcactggcgttactgataaccacgaagtacggcgtcgggttattgacggtaaactcctgaccactgagggttaaggtcaccttatgctgccacgggtttttcatgctgacgttttccagcgcctttggtcgccagaacaacttaatgcgcgtctgcagcgctatctgtagcgtgttaggtttgttcgatttcggcgggatctcacgcacgttgaaatagaacacgctctcgcggtcggcaggcagcttgttgatatccggcatgccctgtaccttcacctgaccgttcatcatggaatcgatgcgctgcactggcggcaggaccgtcagtggcgagctaatcctgttaccctgtccatcttccatccagctttgtgccagatacggcattttcgggtcgttattgcgcagcgtgacgctgattgatttatcactttcgttaaaaatcaggcgtgtacggtccggcgtgacagaggcctgtactgacaggctggcggcagttatcagtaacgccagcgtcgttgcggccgttctggcagagcaaaatagattcgtcatggatcattccttaatcacgttattaattggctgataccgatactggcgcttccgttggcatcacctgctgggtctgctcctggatcaccggcttaatttcatgaggcatcgaaggagatatcgcccctgtttgctggcatggtaataacaggccattgaacagatcggctggcagcgggtcaggcagatgaatatcgcagtgggccacaccgccccatgaaacgatcatatgctcgccaggttttacgcccgcgaggtagacgttgccgtcatcgtcaaccagaccgacgttctgcgcgctgtcgtttttcacttccgcgccaaacggcggataactgccatcttgcagacgcagcaccgccatcgctttttgcccgctgatcaccgagaacttacggtagccaatggccccttcggtaagcgtgccctgcaccacggactgggtggcttcggcgttttccggcaggttgtttaggtcgatatacgcctggttgcggtagtagttgttgacgtctgccaccactgccttaccgaacatattggtgtaaaccgccgcgccatttccttccaccggaacaccagccacaccgtcggcatcaatcagcagacgcgtaccgcccatattctgggtacggtggagcgcgccaccttgtgcggtgagcgtcgcgccgccctgtaaggaaatacccgccgaggtgtactgcccttcatggtagttagcgctgagatcgacctgcgccagcgatccgtcgtggctgtaataaccgtcaacgctggagtgattgtcgctggtgcctacgttcaactggtaatgggttgcgtcatcgacacggctgaaataccccacctggctgctgtccgaaccgctgccgtagttgccgttatagctgatggtgctgctgtcaccccacggcatactgagcgatatgtacacacctttatcggcctggttgtcatactcgtagcggtatccggtcatggaaatgctcatgttgcggatactgcccaggttgaagtagtgcgagagcatgacgttgtagttggtctgttcgtcgcgatcccagtaggtatggcgggtgtagttgagataaacagacacaccggcatccctgaagttctggttataggtggcggtgtacatctctttgtcgttgccggtgcgcaccatttcgctgtcgctggcatcgagatactcgctcatggtcatgaagttctcttccgagaagcggtatccggcaaaagtgacgcggctgttcagttcatcgaagtctttggaatagctcaggcgaaacgagttgccgtccagtgaacctttcccgtaggcggtctctttatccagacgggtatgcgagtgggtgatatcaaaggccaccgcaccaaacacagacaggtcgcgaccgacgccaagcgccgccgactgatagtgttcatctgccagcgccccgccgtatagcgaccagccgttggcaatcccccaggaagcttcgccgccggagaagaaaccgccttccacgtggtgcccccactcctgcgggcggcccatcatcagtttatagcgcacctggccggggcgagtcaggaacggcatcgaggcggtgttgatgtcatattcctgcacctgaccgttctgttcttcaatgcggatatgcagcgtaccggagaccgaatcgccaagatcctggatgcggaacggccccgccgggacctgggtttcgtagatgacgcggcccaactggctgacggtcactttcgcggtggtgtgcgccacgccggagatatccggcgcatagccgcgcagattcggcggcaacatttgatcgtcggtgctgatactgccacccacgtagttaaagccgtcgaaaatatcagaattcaggtagtcttcgccaaggccaagtttggcttttagcgacggtaaggctcgccaggcgtagtagcggctccactcccagtttttttgcgtgtcatcaccgttgataacatcgtcatcattgcttttactatgcaaataatcagtctgccagtcggcacgaagacgccatgcgccgaggttcaccccaaccgtcccgttaccgctaatttcattgctgtcatccccgccattttcttcatgtcgtgtctgggcggtaatactgtagtcagcaattaaaccagatataccgtcatcccagcgtgaaggcggatcccagttgatgtcggtatattcaaggtaagcctggggtaatgaaatgactaacgctgactgactcaggtcagctttaatatcaatgccttccagttgaccgggtttcaggcatttgccgtcgtggatccattgcaggttttttgccacatcctcttttaagccaaactgcgcgaccagttcaggcgtcaggcaggcataggttttactggcatcgttctcagaggcgtaccagtaaatatcgtattcttccgtcagcggctgtttatttagttgaacctgtaaattgtatttcccaggttcgacataaccctggctggaaaatcgcttcagatcgatttttgtgtcgccttttaactccagaaaacgggaatcaaactgaatttcattttcagcccaggcattgacataactcccggacattgccaatgcaacgcagcagggaagtacccgcagtcggaaaagagaatggtcaggcatacacgtatccatccgtaattattataatttgcgcgaattccatttaaaaaccccatagcccgaaagctatgggggtatcacttagagataagtaatctggaaggtcgtgttggcttcaaaattacctaaatctggcgcatcagcagcgcccaccagccaggctttaaagtccagcgtctgcttcgctttgcctttgttggtcgccgtatcgtttacgattttctgttcgatacccgcgccgcttttataagaggttccctgagcgtcaccaatggccaggctgacattgttaaatgccgcaccagtatcggtattgtaaatggtgtagtaattgccgctgttggtagaagacgcgttaccggtgaaggtagtggtcatcgttgtctgggtgtcaaacacacagtcttgcagatggatctggaaagctttcggtgtagaagtcccgttatttttcaggatccctgaaccaatgtcacccatatcaacttccagtttgtgatcatcaggaacgatagagcacggggaatcttcaatggtgccgtagaaacgtgctgtaccattgttgccagcggcgattgttgaagtagaagcgaacgcacccattaccattgttgcagcaatagctgtttttacaaacttactcattatttgtccttaaaccataaataattaaaaatataaacattgcaatacattgattcagtcaatagcaattatttatacccagccattgaataagctatccgatctaactaacaagaaaataggtcgcataagaagatattctttggtgtgggcggatggtgatattttgtctttattgtttcaaattatatttacttaacagcgaattaaggaccgcttaatgtatagccagaatagaaatattttgaggattttcttataaaaaagaaatgaaatacttaaaaaaatatcttacacataatttcaatttatgaataacctgcgcaaaaaagacaatcttagattaagtttgagattgtacttttttgaagttatactattaacacatcacaaataatattaaattaagacacgaaaatatcatttcttttttattattaactgttctattagtttgatgctttgtaaaaatacattacaacttagtctcatttcgtcagaaattaatagggaagcagaggaaaaagtgcgatgaattctgtatcgaagcgtatcaactccgtgaagggttttgagtgaatttctactattgcaaaaagacaaatgcccgatgtacagcttac

SEQ ID NO: 148 - DNA  (genomic), 186 bp; double-stranded, linear
atataaataatgctgaatttactgatggtggtattgatgatcgtagtgatattggcattgactccaatgatacagacgatattgatattgataatcaagaaccaataaaatcacccgcgaacgatgaaaacaaaaaagtcggccaaaccatcatcaatgaaaacatagtagagaatactcatgata

SEQ ID NO: 149 - DNA  (genomic), 12804 bp; double-stranded, linear
gttattacaacgattcttataaaaaagaaaagccttgcacatatagcaaagcttttcacttctcaggatttcttacaccaagaaaccatcaacaataacaaaatgcaattattatatgttaactacatatgcatttcattaaaaccaatcataaatgcttatcatactttaattgctataattgattgccttctattttttcaactcgagtggttgaaacatcattcttaaatccactccaccattttcttagcttattgtttattggcttttcaaaaaacaaatacatcattattgatataaataatgaagcaaacagagccattactataaatttaattacacttatagcaccaagaccagaaacattaaagaacttgctcaatgtactgattactatagtatggaccaagtaaaatgaaaaagaagcatcacctaaaagtatcataactttatttgatattatttttgaaataataccaccattaaacgaaaacactaatattgaaaaggccattgatggtataaaaagcgcatcatactgtaatccattgctattttgactttttgccaccatatagacagacattaggataaagactacagatgatatttcagcaaatgatagaactaaatatgacggctttgacttaaactcaaaatctccggcctgattgctgcggattgtctctgccagcctgcctcggtcaatctcacgaccagccatcttgtcctgaacattgaagtagtcaatcggaccgagagcagccatcccaaggtgataaacaaactcaccaaaccctgaaggattctgctgatacatctgagcaacgttgttagggtcaacaccgacgcgcgccagttccttggcgttgttttgcagccatgattgcattgcttctggagacgaggccgcaaggcgtgcgccagccgctaaggtgccgatagaattgcgctggtcttcgtctgcccacttcataccagactgaatcttctctaattgaccaggatatttggtcatcagatctcgaacctgctgtcgatcgccggactggatggctgccgcatattctttttggaatgcagcatccgcttcctgttgctttgcggcttgagatgtttgagcgacactaccaagtccctgcaacgcctgaaggccgatgttattgcgacctgaacgctccatttcgttgttctggcgaatataggccaacgcctcacttacatcacttgcctttggcgcatttgagttttgcccaccgataccagcaagaaaaccgcctgagttgattccttgttgccaagtagccatattcccaccttaaaacaatgatccaagaccaccgataacaccgccagcaagagcaccaataccagtcccaataacaggaactgcactaccaatcattgcacctgatgcggccccaccaatggcacctgtagcaaaactctgtaggcctgaaggcttattcgcatttgctgccgatgctgccgcctgctgttgatacaattggctgacattgttagcgtagttctgtccggcgtttgcctgacctgtaagagcaccaaggccgatatttgccagattgttgtagttgttcatctgacctgacagccagttttgaccgagtgtaggtgcgattgctgctaactggtttcctgttgctgtagagcctaatccacccgttgcctctgctgctgccagactctgatagcgcgcctgccctgcaaggtctttatactgctgagagttgtaatactggttaagcgcctgaccttgcccctgaagagaggaaagattctgcaactgtgatacgtactgctgagcgagtggcgtgaacggtgcaaggttttgcatgttcgtctgccacatttcacgctgcagttcgatgcccttttcagttgcgcgtgcctgggctttagatccggagtcgctgccgcctttcatatacccattcatgggaagcaatttattcttgaagctttcgctaagtactaacatttaatagctcctcatatttcgaacgaggtaattgatagagggtgattcctaccggttttccgttactcatgtacgcatcatcaaggtgaccaacacgggtagcgccaagcaaacggataattgcccgtccgtatttggtggtgtcaggaaccatggtgatgctgttaaggaatggtgagttttcgagaagccatttgcagaataatcgatgcccttgtagtgcatattcgccacggaatccggggtcatacaccgcatggcattcaacaacgctatgccagaagttacgcacttcatgaactccagccagcactaatccttcgtagatgccgagatataccgcatcaggcttgatgtagtatttatctccactgtctacgatattccccgtgtttaccgggttgttaaggaattctgcaagtttcaccgggttatcgatgagctttatttccatcactgctccgcaatgattttgatggttgtggcagtaaacgccgcgccattcgactgaatggttaacgtgctgccatttgtggcaagaaagccgtctttatccacgctgaagaacgtagctaacaggatgttgtcggttgttgttgccgagttgcgactgcttactagcgtgtcaggaacagaaccggagaatgttagctgcattgacctgttggcggttccgctgggccacgtcccgacaatcgacagcttgaagaacaaggttttgttctcgttgaacacaaccatcttgttgttaacggtgtcgaagaatggtgccaacgtcccggatgacggcgtaagcgttttcagcaggctaacaaggttggtcggcgctgtcgggatggttactgatacgccagagtaaacaacctctgacttcttgcgcgtagtggcatactccagagcattaatgcgcgtttcatggtctgaaacctgcgattccagcgactgaactctggtatcaagcgatgcaatatcgctttcattcaaggcaatcagtgggtttacgtcatggagtgggctcaacaccagtcagagccgcatgtacacgcaataatcatggtgaacgaaagaagcattaatgggcaagctggcaaaattgtcagcaaatgggtaacactggcaaacaatgcaatcccatcaaatgttcctccccagtgggatctagatttgaaaggtcagcaatattcagagcctacaaagtgtataggtaaacagattgattacatggcaaagcccgaaactaagttaaatgactttaatagagaggcgagcaagagcctatatgattggtcagatgccaacgtttggggttattcgaatggctgggcgcggcatgagataaaaaaagaaacactttctatcactggctttcatgctgtaagacgcatactaaaagccgttcaggcatcaaggaaagacaactacaaagctaagcgacagatacagcgtacattgaaacgacaagacataaatcgatcaccaatcaccccgttccaagcaccgttaattagcaaacacgattgggatttatcagtgatagcggtcaccaaagaggcagagacagagcgcagggaattactatcctcacagataataaactcgaacaaagtacaaacccacccactgttaaggatgttaagaagagcacgagtgagagcatccagagccaaaagagaaagcggaggttatgaccattactactagtagtgacagatcgtgacaaggcggtgcaaaaaacgaccaataataagagagatatgcctgccaaaccgccaaaagcgcggagcgcggcaaacgccgcgagaggcgcaagaaggcgaacctatccattgaaacggtcagaagcgcatcgcgctcgacgaccgaagtccccactaacaccgttaacgaaagatcaaagtcttagaaaaaaatgacgtttctttgatggacttccatccgtaaaaatcaaattttgagaaaaagtacttatagaaattaatcgctctataaggataagttgacgttagtttaaagtgataaaacattaaagaaaaaacgtaaaatcaaatacataaaataagtcaccaagggatcattttcagaaaacaacgtcaacgtaacgtcaactctgtaagaacttttttggtcactttttgggttgaatgtacgtaaaaatccccagcagtgaaatttgagcgcgtaagcacaattctgaggggctttttgtctgtaggttaggcagtgtaactaacaatacaagaagttagctctgactaactatttaattaacttttcaatctaattgcgttagatattataccctaacgcaatatttttaattcaataatgtctgtaaattgttattacttataattatacatttaactatatctacattggctgcttccaattactacttacgtaacggaatctcggatcctctgtttttggctcggtataataagaatcatcaatagtaaagttcgacgctaatttatcccgaagcccacctaaacgttcaatgcttgttagttcgttagtaacatccttgaaaacggtagaaaatgctttatgttgtttagacttcataaattcaggagtgctcagtgcaaactctttatcaggcaaacctggaatacccacgagtcctgtcaatgaatttatacattttatcaaaaaactgccttgaataccttgatttgatggaacaccgtagcttcgtttaatatctccagatattttatctaaatcacttagtaattttgttacttttttatttcctgcacttatccccgattcatcgtaggtcacatgaatctctcggattacatctcgacacgtacgaaaatgatcatgtgttctaagctctaaagctgaattgataacttgagagacatttcctgtttcgtttgctagccatgcagaaaatattggtaaatctaatgaaatagtagatgtgcgtccatgatctacaatttcagatcttgcagtactgattttatcagacaacgattgcaccaaccttgcagtataatcatgaccaaaagcacctgtttttttcatccaatgcaattgatatgcatgccttattggatgaataaatgagtctgctttaaaatgcttagcaatgacgctgtaataaatagatttatatgccaaccaatttagcgatgcgataaacatttcaagtgaacgagtcatacctcctttaccgcgagtagatttttccctttctagttcaaattcacgctcagtatattcatgtccagatgaactcactagcttcacatcggttgaccagtaccctttcgtatcagaagcatctgataattcattaaaaatcgatgcacttagttcactatatttcgcatattcaggagtaccgggctgaccaagcattttcattgttaagtaatacacgctagaccgaagatcccatgtgcaaatcatattcagcttaagcatctctacaagttgcctaaaatcatcgtcaacaaactccccacctctaatttcggaagtaatttgccgagattcaacttgtgctaactgatcaagttcactgagttgaaaatcactttcagatacaaatttaataaagtcaaatttagcaatgcgtttatctctatattcttttttataattatctacacagatcagggtatcgtaaaaaagtatcgcttgaataagattttcaaaagcgactaaatctccgttaatagtatctggattcttaacaagaatatcacccagtgttctttcgactgctgttaacgaagcattatcaatcaacgcataagacattaaactacctccattagataatatttaataacattatatttcaattaggtttgcaaattgtgatacttatgacagatttgagtgacattttatcaatctactgattttgatggtgaaatttattagaaggtatgcgtagtgctacgggagaaatgagaaacgcgcccagcaatggcgcatcctttcttaagcaagttggctagtatctatagcatccatccaatcaggagcaattcccaaacgttccgcgaactcttcattggtcacgtcttccattgagagactagccagacaatcgttaatttcagaatagacgggggaaagtaataggtattcccgcaactctttcaggtctttttccatcttaacactccttgttaatagaccgtcgaacaatggtacagatttgtaccattccaagtactggcaagcaaccccaccagcacaacaaattatctcatacggtaaaaacggtgtcgggctgtttctttcggctagctcaatatatcaccttaaacaccagccgttatcattgtctcaattgggtataccgtaatgacaaggtgatacaaagtctcaatagggttgtataggaacattttgactacacaaactgcattatgtatcatttgcacttatattcacaacccttttgagacaatgcaatgaacgttagaatttactgccgagcatcaactgaggggcaacacgctgatcgagcacttaccagcctacgtgaattttcaaaatcaaaaggctggcagattgcaggagagtatatagaaaatgctagcggggcgaagcttgagcgcgtagagcttatgcggctattgtctgaagcccagtccggcgatctgttgctagtggaagctatagatcgtctgagtcgcctagaacatagtgcatgggtcgaactgaaagatacgctcaaccgaaaagggttaatcatcgtatcaatggatttaccaacgagctggcagatggtcgagatggcaggcaatgatctaaccagcggcatcctgagagccgtaaatgccatgttgattgatatccttgccacaatggcacggcaggattacgaaacacgccgtaaacgccaacagcaaggcattgaacgagctaaaagcgaaggcatatacattgggagggcgaaaaatcaggaagcccgagagatcgttagagagatgttggagcaaggagtaaaacctgaactcatcatgaaggcagcaggaatcagccgagcgacttactaccggataaaaaacgagctattgatcgtaaaatcagaataaaatttgaaaggtcgtcaggcttgtttcatcaggtaaaaaccagcatttctgatcacaacgcttgggggcacctattggggcactcaccaaaatcgaaagagaaataaactacaattcaaattgttagctaatttttcgattcctgcagggacaccagatacccttcaaaccaaatctaccttcatcccgtaaacgatgggtttggcagcacacttgccctatatctactcatttttactgcaacaggttgaaatctcagcactgtcagaaagcgctgatgactaaacagcccagggccgggcgatgtaaccatcacacagaatcctgatagcgaaatacggcgtgactcgatacttcactccgcaatgcattccttgatgaattcgcaggcccgtgatacacgggacaggtcgcagaatgacgacaatgtcctggaaatcagcgaaccgtgtatccggagtacatttgagcgactgtaccagaacatgaatgaggtgtttggattaggcgattattagcagggctaagcattttagtattattattttccggttgaaggatatggagatatcgacaacaaccggaaaaagtttacgtctatattgctgaaggtacaggcgtttccataactatttgctcgcgttttttactcaggaagaaaatgccaaatagcaacatcaggcagacaatacccgaaattgcgaagaaaactgtctggtagcctgcgtggtcaaagagtatcccagtcggcgttgaaagcagcacaatcccaagcgaactggcaatttgaaaaccaatcagaaagatcgtcgacgacaggcgcttatcaaagtttgccacgctgtatttgaagacggatatgacacaaagtggaacctcaatggcatgtaacagcttcactaatgaaataatccaggggttaacgaacagcgcgcaggaaaggatacgcaacgccataatcacaacaccgataagtaatgcattttttggccctacccgattcacaaagaacggaataatcgccatgcacagcgcttcgagtaccacctggaatgagttgagataaccatacaggcgcgttcctacatcgtgtgattcgaataaacctgcataaaagacaggaaaaagttgttgatcaaaaatgttatagaaagaccacgtcccaacaataaatatgacgaaaacccagaagtttcgatccttgaaaactgcgataaaatcctctttttttacccctcccgcatccgccgctacgcactggtgatccttatctttaaaacacatgttgatcatcataaatacagcgccaaatagcgagaccaaccagaagttgatatggggactgatactaaaaaatatgccggcaaagaacgcgccaatagcatagccaaaagatccccaggcgcgcgctgttccatattcgaaatgaaaatttcgcgccattttttcggtgaagctgtcaagcaaaccgcatcccgccagataccccaggccaaaaaagagcgcccccagaattagacctacagaaaaattgctttgcagtaacggttcataaacgtaaatcataaacggtccggtcaagaccaggatgaaactcatacaccagatgagcggtttcttcagaccgagtttatcctgaacgatgccgtagaacatcataaatagaatgctggtaaactggttgaccgaataaagtgtacctaattccgtccctgtcaaccctagatgtcctttcagccaaatagcgtataacgaccaccacagcgaccaggaaataaaaaagagaaatgagtaactggatgcaaaacgatagtacgcatttctgaatggaatattcagtgccataattacctgcctgtcgttaaaaaattcacgtcctatttagagataagagcgacttcgccgtttacttctcactattccagttcttgtcgacatggcagcgctgtcattgcccctttcgccgttactgcaagcgctccgcaacgttgagcgagatcgataattcgtcgcatttctctctcatctgtagataatcccgtagaggacagacctgtgagtaacccggcaacgaacgcatctcccgcccccgtgctatcgacacaatccacagacattccagcaaaatggtgaacttgtcctcgataacagaccaccaccccttctgcacctttagtcaccaacagcatggcgatctcatactcttttgccagggcgcatatatcccgatcgttctgtgtttttccactgataagtcgccattcttcttccgagagcttgacgacatccgccagttgtagcgcctgccgcaaacacaagcggagcaaatgctcgtcttgccatagatcttcacgaatattgggatcgaagctgacaaaacctccggcatgccggatctccgtcatcgcagtaaatgcgctggtacgcgaaggctcggcagacaacgcaattgaacagagatgtaaccattcgccatgtcgccagcagggcaagtctgtcgtctctaaaaaaagatcggcactggggcggaccataaacgtaaatgaacgttccccttgatcgttcagatcgacaagcaccgtggatgtccggtgccattcatcttgcttcagatacgtgatatcgactccctcagttagcagcgttctttgcattaatgcaccaaaaggatcatcccccacccgacctataaacccacttgttccgcctaatctggcgattcccaccgcaacgttagctggcgcgccgccaggacaaggcagtagccgcccgtctgattctggcaagagatctacgaccgcatcccctaaaacccatactttggctgacatttttttcccttaaattcatctgacttacgcatagtgataaacctctttttcgcaaaatcgtcatggatttactaaaacatgcatattcgatcacaaaatgtcatagttaacgttaacatttgtgatattcatcgcatttatgaaagtaagggactttatttttataaaagttaacgttaacaattcaccaaatttgcttaaccaggatgataaaaatgacgcaatctcgattgcatgcggcgcaaaacgcactagcaaaacttcacgagcgccgaggtaacactttctatccccattttcacctcgcgcctcctgccgggtggatgaacgatccaaacggcctgatctggtttaacgatcgttatcacgcgttttatcaacatcacccaatgagtgaacactgggggccaatgcactggggacatgccaccagcgacgatatgatccactggcagcatgagcctattgcgctagcgccaggagacgagaatgacaaagatgggtgtttttcaggtagtgctgtcgatgacaatggtgtcctctcacttatctacaccggacacgtctggctcgatggtgcaggtaatgacgatgcaattcgcgaagtacaatgtctggctaccagtcgggatggtattcatttcgagaaacagggtgtgatcctcactccaccagaaggaatcatgcacttccgcgatcctaaagtgtggcgtgaagccgacacatggtggatggtagtcggggcgaaagacccaggcaacactgggcagatcctgctttatcgcggcagttcattacgtgaatggactttcgatcgcgtactggcccacgctgatgcgggtgaaagctatatgtgggaatgtccggactttttcagccttggcgatcagcattatctgatgttttccccgcagggaatgaatgccgagggatacagttaccgaaatcgctttcaaagtggcgtaatacccggaatgtggtcgccaggacgactttttgcacaatccgggcattttactgaacttgataacgggcatgacttttatgcaccacaaagctttgtagcgaaggatggtcggcgtattgttatcggctggatggatatgtgggaatcgccaatgccctcaaaacgtgaaggctgggcaggctgcatgacgctggcgcgcgagctatcagagagcaatggcaaacttctacaacgcccggtacacgaagctgagtcgttacgccagcagcatcaatctatctctccccgcacaatcagcaataaatatgttttgcaggaaaacgcgcaagcagttgagattcagttgcagtgggcgctgaagaacagtgatgccgaacattacggattacagctcggcactggaatgcggctgtatattgataaccaatctgagcgacttgttttgtggcggtattacccacacgagaatttagacggctaccgtagtattcccctcccgcagcgtgacacgctcgccctaaggatatttatcgatacatcatccgtggaagtatttattaacgacggggaagcggtgatgagtagtcgaatctatccgcagccagaagaacgggaactgtcgctttatgcctcccacggagtggctgtggtgcaacatggagcactctggcaactgggttaacataatatcaggtggaacaacggatcaacagcgggcaagggatccgcgtcacacttcccccttcacgaccttcaataatatgcaatgcagcttcccgcccgataatgtcatgtggaagctgaattgtggtcagcggcggtaaaaacagatgcccgacgccaaccagattatcaaagcccattacggcgacatcctgcgggatacgtacccccttagccaggagaacctgataagccacaaaggctgcgcgatcgttaccacatatcagaacatcaaaatctggtttgcccgatttgaagtggtcattgagtaaacttgcgagatcggtgtagtgatcatcacctgttgccatgtgaaattgtttcacctcagccagatctcgtccagcatcacgccaggcctgctcaaatccctgccgacgataccctgttgccaacgcactttccggtagccagaagcataacggttgacgatagcccgccgcgagcaaatgctgtgttgattcatattgtgcagtgtaatcatcagggatataactgggtaacgctgggtcatccgccacacagttcgccaatacaatattttcaccatacagagactcaggtagcgtgatatgtcgcagccccattgtagtatagataatgccatccggacggtgggcaagcagctgacgtgccgcgcgggcagcgtcatcttcagaaaaaatattgattaaaaaactattccagccgaactcgctggcggtttgctcaatggcaagcagaatatcaacagagaaaggagtggtagcagtgtcctgcgccagcacggcgagagtcgacggcttacgtccttgagcgcgcatcttacgggcggaaagatcaggaacataattcagggtctggattgcctgcaatacgcggtcacgcgttgcaggacgcacagattctgcattatgcatcacccgggagactgtcatcatcgacactcccgccaggcgtgcgacatcctttaatgaagccatacccaagccgtttgccgtaaaacgggcactgtagcagaaacagacgtcactggcgagatccaacgaaattctcgacgccctatcacccgacacggcaatacaataaaaaataacaataattgccggataattgtacccaattccgcctctgttctcgccaacgagtgaccatataggcaagtaagaaaaacatgccaactggcatcgccaacctggagaagaaaatataaatatggatcattgt

SEQ ID NO: 150 - DNA  (genomic), 1748 bp; double-stranded, linear
tgacatcctccacgccctgaatgacgaggatccctgctacgttcaggctgtcgcctgaatcatttcggtgggttcctgcttcaacgagcggcctgactgcaccatctctccacaggcaagaacggcgtgccccgccgctaaaatgttacgagcgccgtttacatcggcgttcgctgtatatccacatacctggcatctgaatttactttgtgacaggcggttttctttcgctgtatgaccacagcacgcgcaacgctggcttgtgtacgctggcggaacagccagtacctgaccgccacgccagagctgcttgtactcaagctggcggcgcatttcataccagccctgatccagtatcgaacggtttaaacctgattttgcccggacattgcgccccggctggctgaccgtacccgctgctgactttgacatgttgctgaccttcaaatcctcaatgactatcattgcgtggtttttgctgacggtcgttgtgactttgtgaaggtagtccctgcggatatttgcggtacaggaatgcagtcgctgtattttgcgtttctgcttctgccagttattgctgaatttgaccttgcggcttaactgtcgctgaagtctcgccaacttcttctggtttttctgaaaactgtttacaggctcaaagactgtgccatctgacagcgtggcgagtttagccacgccagcatccagtccgaccattgatgctgaagggtgaaccggagttgatacttcactttctgtctgaatactgatgtaccacttaccgcaggactggctgacagtgacatttttcacaacacccgtgacctgacggctgttcaggtagcgcatccagccaagtttcggcagaaaaatacggctgttttcctgatcgagcttaacgccctgcgggtagcggaatgcatcattctgtccccgctttttgaatcggggaaaagcagcccgcttccggaagaagtttttgtaagcccgctcaagctctttcagtgactgttgcaatggctgtgacggggcatctttaagccattgcgtttcagtggcgtttttccactcaaccagccaggaagccattttcccgtaagggatgtatttattaccggcctcatgattctcattctgaagcgccagagcacgattgaaaacgaaacgacatgcgcctgcgaagcgcctcatttcacgctcctgttgaccacctggtcttaactggaatttaaatgcctgtagtcgtttcacaggccaaatgatactttggtctatgaataaagaaaccgatatccgacggggaaggcattgtgttttcctgatgcatgttcatctgttctttgtcaccagataccgacgtcagatttttgactatgacgcgacagaaaaactacgcacttacttttcaaatgtatgtgctgattttgaagctgaactggttgaaatggatggcgaaccagatcacgtccatttgttaactaactatcctcccaaactggcgatatccagtctggtaaacagcctcaaaggcgtatcgggtaggttactgcgacgagatcgaccagatattgcagtcaggtattactacaaaggcgttttgtggagtcctggctattttgccagtagctgcggaggtgcgccaatatccgtcatccgccaatacattgaacaacagcaaacacctggtcaggtggaaaaccgcgccttatatccccgccctgaaggacggggttttacggcgcaccgga

SEQ ID NO: 151 - DNA  (genomic), 396 bp; double-stranded, linear
tttttcttctcaagttccttgttcttctgccgatattacctcgtacagtgacgaggactgaacaatggccactatctcttcaacttcaattccttccatacaaacacagagtagtaacagggcatcacaaggtagcgatgttgcttcacaaatcgcgcggataagtcagcaaatcatcaaactcactcaacacattaaagagattgtagacactagcggcagtgctgaagacaagcaaaaacaggccgaattgattcaacagcaaatcaccctactggaaacacaactggcgcagttgcagagacagcaggcagaaaaggcgcaggagaaagagcagcgtttgtctctgaatgtatcccttctaaatcctgttgaaaatacgactcatatcggtat

SEQ ID NO: 152 - DNA  (genomic), 35 bp; double-stranded, linear
ctgatacggtcttatcaggcctacccggctattat

SEQ ID NO: 153 - DNA  (genomic), 48 bp; double-stranded, linear
tagccctgtagggccgctgatccgcggcagtggttttgcccgtgattt

SEQ ID NO: 154 - DNA  (genomic), 4859 bp; double-stranded, linear
tcgacttttatggtgttctcatcccataacgatgacgttggcaataaagacaattttgcgcattttgctgaaaagtaagaaaggatttttgacaggttttacagactttgcgattagcatgaagattcacaatttttgccggtagaatcgtcaattcaacggtcattgcctgatgaaaacaaacagcaatacaattttggcatccgttacacaaggcatcatttatttgtaaatggccttcgttaagcgaaaagacctgttgctcgcaggcccgccagcatgcaccgcaaagctgacacttttgaggatccatcatcgggcgagcatcactaatctggggccataaataatgtaaccgacgtaatcctggttgtatttgtgtcatctgaacatccgcacgctgcacatggaacaaacgacgccgggaaacattcacctcactggtatgtggagataccacagaccagccttcctcgccatattgccgtaagcattcgtttaacagcaataatgcgcgctcccatgccttcgcctgactcagatcaatcgcgatcgctgtgatcccctgctctttatgccatagcaaaagttcttccagcgtcggcgcaatagtggtgaaaggtgcgaccagggtgtgattgcaaaaataacgtaaaggggaattaacgccacgaatagcctcttgcggacaaataaactggcaaaccgcacaatcaatacattgttccgcgtcgaccgctatgccctcttctgtcagcgttagcgcctgtgccgggcaagcctcgacacaggcatgacatgttgcaaaacgaaagcgttggcgcgcgcattccgcgccaatcgttatgttatgacttaacattagccgatactaaaaaagacaaaacgcagcataacttcactccccactagcattacgctaccgaataacgccgccgggatattctttttacaaccaccgacagcaaagaacatcatcccaatgacggaaattccccagcttagtgtcagtatgggttttaactgtcccagcatcgctaatggcgcatgtggcaatgtggctatctgcatcgcatttgccgttaaatcccctatccacaacggctgaaccaacaaacgcagcagaaccaggagagcgatcaccaacacgcatccattacgcagggcatcaatctgcggcaaaattccgctaatacgaaacactgctaccagcgctgaaccgagaattcccactgtacctaagaacataatcagcgtgttgtaatgctgccaggtgataatcgacgtatggatgtaaacttgcgccatgcagaaaacatcaacaatcccgaccactgccgctagcataagcaggagttgccagccgcctttgcgtaacatgaccagtaatgtggataaacccaatagcgccagatacagcgcaccaaagataatttcccgactcagccatgaactggaaaagtggctcagcgcatgcatcgcattaagtggataacccaggtgtaaggtagaaatcagtaaccctacggcacctgccaaaaaagccaacagtaatggcggccgcataaccgggcgggcgctggaggtgattaaaatatgacgatgaagaaacgccagccacaacgtcataccgaccgatgcctgtaacaacagcgtaaaagccattaacggtaattcatgcatgatgtgacgcctccttttccgcgccctgatgcggtttaatcaccagatttggctgcgtaatcgacgaatcaggtaaacctttcacatcactgacatcgccatacttttcacgcaactcatcaatagggccgaacttaatcgcccccaacgggcacgttgccacgcaaatgggttgttctcctttagcttgcagatcaatacagaaatcgcatttcgacatctgcccggtctgctcattcatttgtggtgcgccgtaaggacaggaccaggcgcagtaaccgcaaccgacgcacttatcagtattcacgcgcacaataccgtctccgggacgcttatgcatcgccatcgtcgggcaatttttggtacagatcggatccgcgcaatggttacaggaaacagaaagggtataagcaaagacattatgactcacaccgccctctccagtggcgatgaagccacctccgttcacttcatacacgcggcgaaaacgtcgcccaacctcaaggttgtttttgtctttacaggccacctgacacgctttacagcccgaacaacgcgaagagtcaataaagaaccctaattgtttgtcgctgacagatgcaaattctttaaattggctcatgctttctcaacctccaccagcattgtttgatgcgaattccctttcgccagcgccgtaatgcgggtcgaactcagtacattggcacagcctccgcgatcgataccttgtgcatccggttgccaccatgcccccgcctgcatagcaactacgccagggatgatacggggggttatttccaccgggataatgctcacaccacgatcgttataaatttttacgctatctccttcgctaatcccgcgctgttttgcatcttgcggattcagccagagtttttgcgtctgaacttcttgcagccacgggttagcatactgggtggaattagcacggtttttccctttccaggtgatgagctgcaacgggtatttcgccgtcagtttatcttctggcccttcaaaggcagggacatagtgcgaaagcgcgggaatttctggatcttgcatatcaaaaagacgcttagagaagatctcaattttgccggaaggcgtcgggaaaggattattctgcggatcgcgaatatttgcttcgaaagcgatgtgcggcgcgcttttgaaaagatgtcgacgtgttttttgcagggttgcgaagtccggcaaattttcatccggcatcgccagacgagtttgctcccagatatgctcgatccattgcttctcatcacgtccttgactgaactcggcttcgacacccagttttttcgccacgtcacgcaaccagtcataatcggtgcgacgttcaaaatccggctcaatcggtttttctgacagaataagatagctcgcagttccccatgtttcgccgatattccagcgttccataaagctggtttccggcagcaacacatcggcatatttcgcgctcggagtcatgaacagatcgctgagtacgatgaattctattttagattcgtcttcaaggagcttcgcggcctggtggacgtccgggttctggttcgccagataattacctgccagtgagaacagcaggcggatattactgtcgagtttatcgacacctttaagcccatcttgcggcgtaactttagaagcatcatccgccgcctgcatccagttcataatcgagattttcgcttgtaccggattttctggcatatctggtccaacgcagaatttacgattagaactaccgccgtaacctgccgcccagccacctttgatgccgacgttaccggtaatcgaggccagtaaagttgaacctcgggcggtgcgttcgccgcaaatatgtcgctgtggcccccatccctgaatcaacgctgcgggttttgtagtggcgtaatcgcgtgccagttgacgaatggattgtgctggaacgtgggtaattttttctgcccattccggcgttttgtgtatcccatcttttgcgccaaaaaggtaggcaaccaacgattcgttggctggtacgccttccggcatggagttttcatcaaaaccgagagtatatgtgtcgataaatgtcttatcgtggagattctcgctgataatgacgtacatcatcgcgtccatcaacgcattgtccgtggtcggcaacagcgggatccactgatcggcaagtgaagatacggtgtcggaatagcgcggatccaccacgataaaacgtgtaccgttttgcttcattttttgaaaatagtaattggtgtgaccgaatatggtttccgttgggttatgcccccagagaatcaccagtttggtatccagaagagtatccatcgagttaccgctcgcggccacgccatacgtgtaaggcgtggccgccgcagtattacccagactaactgagtgataatattcaagataaccaccggttaaatttaacagccgacgcgccatcgcatcgccagaaaatgttccaccagaaacagccgtcccgacatggacataacgtgaagctgggccatattgttgcgtgatccttttcaggttatcggcaattaaggtcgtcgcctcatcccatgagatacgctcaaatttaccctcgcctcgtttacctacccgcttcatcggatatttcaaacggtctggatgataaacaaatttacgatagccgcgaccacgaacacaggcgcgcataatcggcatttgtggatccaattcgttatcgggaagcgtggtaatttgcgtcaccacgccgtcgcgcatatgcgcccgaatatcgcacttaccaccgcagtcaaatgtgctacaggtgggcacgactttatcagctactggagctgtaacttctggcgacgcatctggggattgcgcctttgcggtagaagaaataaaaggcaaagtgataagcgcggaagtcgcttgtaaaaaactacgtcgtgatacttgcggaaatgtaatgcgttccttttcgtctggcgtatccatcttgcgttcccgaaaatgaaaaaataaatattcacgtatttattcgagaacaatgctgataacaatcaaataattagtcgtttaaaaaaacgtgagattattaaattattaatgcattccaaatataaataccataattagattaataaatattttgtatatttcactgaaatgaa

SEQ ID NO: 155 - DNA  (genomic), 42 bp; double-stranded, linear
gttgaaatactctcttttatgcctggctgtgtcaagataata

SEQ ID NO: 156 - DNA  (genomic), 132 bp; double-stranded, linear
ttccagaccatgggcgggttgagggcaattattcgcattattcgcattagcgcaggcctgttcccctcaccataaccctctccccgaaggggcgaggggaccgtccgtgcacttatctggcttagccctcag

SEQ ID NO: 157 - DNA  (genomic), 4190 bp; double-stranded, linear
tttaagaaggactacaaccggacagtagcaataaatacagccacttacggacacaagccagacagtagtcggactgaaaaaagacaaaaatatacacgtgaaatgcacgtgcacttctaaaaaaccccagttatcaccgactggggtttttcaatttgtaactaagggtaacaacccccccgtttttttcatctcactcaccttgatactgtttatttgtacagttaaaaataatactgtatacaaacacagtatagagggacttttatgcgtattgagatctgcatagccaaagaaaaaatgactaaaatgccaaacggtgctgtggatgcgttaaaggaagaattaacccgacgcatcagtaaacgttatgacgatgtagaggtgatcgtaaaagccaccagcaacgatggcctttctgttacgcgcaccgccgataaagattcagctaaaacttttgttcaggagactctgaaagatacctggaagtctgctgacgagtggtttgttcactaattaacacgtaaaatcggtaacggctggaaatcattcaatactcgcactatcgaaagttcaccagccaaccgcagcacgtcctgcatacgtcgtgtctgcggtttttctttttcgcttacattgtgtctggttcttccggccactcaatatcaggtgcagttgatgtatcaacacggttcagcaacacccgatactttttctaggcttccagcaatgaggtttcttcctccgttgcaatttccagatctgcagcatcctgaagtggggcgcaccacgcaaacatcacaaaatattgtcgctgcgatgaacctgtacaataaataatgaatcacggtacgtttctgtgtataacgtactgtagttttctttacgatttatagctgtactggtgagccatgagtaatctgaatccatgcatggcgtgtggtgccgttgtgcattttctgcgtctcttttactggtccgaagccgatgatgctgaagcagtcctctcctctagcctcatccctgtatagcacgcatcaaataatctgggatatcatttcgtagttttacaatatcaatatccgaatcgatatgtttctggtaaaacttgtccgcaagcaagtttgctatggtatctgatgtacgattttttacatcccggctcataccatcacaaagagcatccattttcttgccaaaagaagcactccccattattacatgattaatagaactttgtgctgccttaacatcaagggttagttgattctcctggctcacaagaaaaaagactctttgcctctcttcagtggaaatttttgcatttttttgaaaacagtaattatcaatctcctggttgatcacccttgagggatatactatccgttcatcttttatccactcatcaatatctttagtactctgccttctcaccgtttccagtatattgccgctaaatttgcgaacagaaaagctaatagtccgttctccaattgaacattttacgacctcatcattcttccctcggaaagagttcctgaaggagttctctctatggcaacttataccaaaagagctgaaagacatacctgtagtattcatcggcattataattcctttttataaaaaagtgtttacaatattgcatacttgcgtttattgtagccagaaaaaacatgcatgcaataatattctattaaaaattgtattgttttattcacatatcatgagcggcatgttgattcttgttaccaatatagttcacaatatggattaaaaaggataataatatgccagtcatattaaatttttctaatggaagtgtattgccggaaaatgagctggaggctttacgacatatagcaagaagcaaccagaatgacactattactataggaggccgtaatatgaggcttcattatatccagtttatggatggttttagtgttgagcctattcttggtggactttgggaccatcttggggcaagagaggctcatcatctcgcagaccgcctgacaagacaacttaacggaggtaacacttttctgcaggcatacagcttatatctggagcagaggcaagctgccccgcttgtgcaggagagcgtcataaaaacactactagatcgaataaattcgaatgcatttcccgttagtttacaagacttttcctgtactgaggaacatcttaattgtccgataacgctacatattcctgagacaggtgtttttgtcagaaatgctcgaaattcagaaatatgtgcattatatgatcaggaagcattgactgaacttatcctgcgtaacgctctccaccccctcagccgtgacccctttgctccagaaatgattataagcaaagacaagtgtcattttaatataacaaaacaatgtttttacgcattacccatatacccacttcaacaaaacagtatttaaaaataaaagcacaatataagaagcatattttcaataagttaatcaccatataacaaacatatagcgaggagactatttatgcccaaaatatcatcagttgtatcatcatgttaccatctgttcagtgaacatcaacaactttcaaatgaaacaacaatgacgaaccccgtctccagaagaattgttcataaagaatatggtatatctttaaaatccgttcctgtatggttggctacagctaaaactccccttgctctactcaatggcagacatacaagaagtcactcatttattattgcagggaccccaggaatgggaagcaggagcggagcccaatactatgccataaacagtgatgataaacgctcccgaatagacattgactctttatttttaaaaaagttaaataatgtgcgaaatcaaaataaatttccaatcgatgtaaaagaaacggttataaaactacaagggcaaaaattcacatgcattgaagatttttataaaaggtataatgaaaccaggttaaaggccaataccaatatccaacaagaacaaattgcagatgaagtaaaatcacttacatatttgattccttcagaaaaaaaagagatgtggatatataaaaacaatggaaaagataatgcaaaaccaaacttaggagagcgagacgtaagaatgttcgaaaatattagttctgatgatacagataagataacaggaaggaaattttcagagttaggtgagtatctttattcagggaatgtaataaaactcagtcagttatcaattcgttacttacccaatatcagctcaatctcattaatagagacaaaacagagtttgttgctacatcgattgtattcagatgaagtacttcagagaaatggaacgcttatcccgacaccactacatgaagaaaaatcaattccagctgacaatataaaaacaatgctcaacaacataccgacttacaaaatgttaccgccattcacagaaacacaaggtaattgttcttctggcgcagccacgtttttacgcaaatcaggcgccgaagaaaaagatattcttgcatgtagcccccgaaattatgggctgcatcataacataaaaacatgggaccccttggttagaaattaaggatccaaatattatatatttcatataaagcaagaaaaaaatattgtctgaataattgttcagacaatatatccttacatggcactattataataaactattaatataaaaacacaccaacaaaaaaaattaagcatcacttgcaacaaaggattctttttttgaatcaaagtgacattcgtcttttctcataatcattgattctgttataggttctcgactcagaggatgagctccaccagtttcaacaagttgcactaacgtgtccttatcatatagagagcatatctcagcaccttgtgagtttctcatgaacactccattcgcaggtgtgtccagcgttatcgggcatgtcaaaaatgactccgggcaagaaaagtgattagaatccgttccaaatacacaggaatttattttttccattaatattttattacttgttttattttctctgtgttctgccatgacactctgaaaatagttattaacactccttaaaaaatcgacacctccatttaattgcctttccagagccacagcccttctctccattcgattctcacgccccaatagcctatccagtagatttgcccctatatttccagacacctg

SEQ ID NO: 158 - DNA  (genomic), 17136 bp; double-stranded, linear
ctctgaagaaggtaatagcagctttccctcgcgccattgttgtcgccatttgaacaacagattggcgttaatgccattttcaagagcaagttttgagatggatatcccgggttcacaggaggcagcaacgagctgctgtttaaattcgggaggataattagggcagccttttcgcctgccgggagtcacatttttctgcatatctgatactttggttcccactacttatttggtggacaccactttgtctaattcgtcagattctgaccagacggttcaggctgtacgcttacccttcgacagcttcatgccaggaatcacaggcttaccatccacccgggtggctccacggcagatggtccagatacccgcaccatcacggtatgctgtggtgtggttaccttccttttcatccagaaactggtcgaggatttcaggcgcagacgcccctgcaccaatcagcgccagaacggcagccgacaggccgtatctgatttttgcgttcatggatatttatcagggtttatcgatttcaaatccctggatatgttaagtcttcaggccagcggtggagtcttcagagaacccgtaattattcccggtagttttcctctgtaggttatcaacacatcctgcgcctctaaaattacgggacgcttttccggtaacggaccatccccttcacataacccggcagcaacatccatgaaaaactgcttcgcctgctttttcgcctcagcttcgtaaaactccagcgtggcaccttcagtacggtcaagactaatcgccacatctggcaacaacagtgacggatacccaccaatttccagtgccacagtaacagtaatcttatccgggtaattatttatccctttaacaaccagttcgtattttttcttcatcactttactctccccgcgccgccttacgccggtcttctttaatcttgaaatacaggttcgtcagatatgtcagcagcccaaacagcagactccccagcacgcctatcgccacccactgggacggagagactttgtccagcagctgcagtaaccagtatcccgtccccaccgctgacgtggtgtatgacacacccgttgtgattttttccatctggtacataccccgtctcccgttatccggaagctgacaacaataaaaaagccaccagttaactactgatggctctgataactcatgcaggcgtctcagacgacccactgacactaccggtgagtttaacgataccttccatttgactggctcactttttatgatgatgccggtgcatttatctccagcaccagactttctatctcaacgccatacgctgcattttttgtaacatccgtcagcgtcagcgcattcagtcccagtgtcatactgtcttttataacctggaatgccgggccagccactccattcagtttcggagtaaccgtggcactgccggcggtgaacaccagctccagcgtctgccagtcgttaccgtaatcgccgaactcccccagcttcgtgtttccggctttcctgtgatgcatcagattcactctgccgtcagtggtctgagtgaagtacgacatcaggaacggattaccggtacccgtcatcgccacaccatcaggaacgggagcatccgtatacagataaatccccagcccgaactgattgttggtcagtgcgcctgacaggcggaacttacaggtcagtctgccgccctgtgtcagcagggtaattgcgtcatccaccggatgcgtcagggaccaggttttattgctctgcttggtgatcttaaatacaccatctgacaactgaattccgccatccttaatgctccagccctgcgcagcagcctctccggctgccggcagcagggagattgtgcgaacggacgtatctgcagacggacccgatggcgtgttgccgccgggcgagggtttgatttccggtgccttaccactgatgaaggctgaggtgcgcccggctgcgttcagaatagcggttgccatacgatccggaataatgctcctgcgcgcccatgaactgaaatgtgtcgggcggtttgatgatacctggtttccattcgttctcgatgccgcaccgtaatatcctgatgccggaatatccggatcttctgccggcgcgttagtggcggtattgacgccgttaccgtctgtcatgaagggcacaaaataaacgccctcactctccctgtttttgtacgccccgtaaatggtgttgtactgggtgccgtaggtatttttccagtaatacgtcgtgtcaccacaaatccacggcacatctgcagcactgccaccatggcactgcgcgttaaacacggagaggtcagcacgaaactgtgccagcatggctgtaaacagcgcaggttgctgtgcgtgggtggcggcgctcatgtcaaactctccctgcatccagcacaccgccagcaacacatttttcgggttcttctgtaatgcagctttagtgcgcgcaatcaggtcctgatataacggtttacccacaccccagcgcgccgaatcctggctggcccccgcgtccgcactgaatgtcccctccgcgccctgggtgaatgccgaaccaccacgacagcatggtaccagcaggatccccgcgttattcgggatatacggaagcagttttttggcaatatgtaagccctggccgacacagccgtactgccctttgctcaggtctgccttcggatgattcagcgtactcatatcctgcacatcatgcaggcagtggtcggccggaataatatcgttatatctgcaggcagccccacccggcgtaactgtactgcggcgcgccagctgtttaatgcgcggatccggagcatcgtatgaatccggcagcggaagcccttcaccgtaagccatggcattggactgcccggccagtacgatgacgtagtaccaatccggctcagttgcaccactgaccaccacatcaccttctgctgtaatcacctgcatcagggtataaggggttatggccaccggactaccaaacggctgccagccctctttcagtttgtgtgtcagcttttccgcaaggtctgacggcgacgccgccctgacaacatcataatgtttaaatgtcattattcctcccggccgggatagtgtattaaatcagatatggagtgggctgtagtccggaagcctgaatgacacacggggactacagcccaagaaatgaaaaaaggccacgcagttgcgcagcctgataaaccctggttaaaatccacacgataacaacacaacaatatcagtatctcatgctattgcccgaacccattcgggcattttttacccataaaaaatgcccctccggagaggggcatgtttgcatgcacattctttttcttgcatggtgccgggtgcctcccggtgaattcagtatcagcacctgaatccgcgattatcacatatacctggttgctgattgcccctccgcacagggggattcaccatgcagtagtatttttaataaacagtaaacaaaaaaatcaagcattatgcaggctgtttctttttatcaccggccacagcaataccacaatgccgcagaccagagcgccatcagtcagtaccaacattatcctgctggtgaaatccatcatcaccatcactaaaagcaggatcacaacagcaagcagacacagtttataaaacaatgttcagaaaacgcattcagcatgcctaaggttctattcctacgaatagccaacttgcaacttaaaatattatttatgcagccaattaaattctggtccttacaatatcaacctgaagattcttatcttgtgctgattgataaatcacaaaccttttactacctgcattgaaagaagtagacaaaaccagacaattatcataacgagcaagaacataataccaaccatcattataattaatcatttcatattctttcttaaactgcggtttgtaatatcctgtcagaaatgaaaaaagccagaaatatgccacaaaagcaatcatcacaatctcaaaaaaatgtttttttataaatggcttatcatagaagcatgataccgataaaaatcgcccataagatcttatcgaaattgtgaccgccagcgcaatcgctgctgacagtagcaaaagaggtacctgaatcttctgtctcaatatagaaaactcaataattgccggcacaaacaataattccacagcaaaataaaggcgaaatacatttagctcttgcatagaatgttttcttttcactgcgaaaaagaatacaacaccaataccccaaccgataagaaatatagcaatgacgataactgcaaaaaataaacttctggcaacatcatcaacacctgcacctacaatccaccatgggaagccgtagtaaaaagaagtaccccatccatagaaataagcactcccccatccaaggcatcccatgtaggcaataaaaagtgaagaactcctgagcagcgcaccatccttcataaccaccccaatacaagatgataacattggcttacaactcataacaaaagcaattcaatgccgtcaagaggttacaggctaaaaaaactctattacattgcagtcagcatgtttactacacaaatacaattcagagcataaaaactactcggcggcaggttattgagactcatcaatgacatgtaaaaaacgcccattattggtgtcaagtttccccaaagttattcaaaaagtcaatattatgccgttaatatgttgccatccgtggcaatcatggcgctaacgtgtgatcgcattcaaaatgttgtctgcgattgactcttccttgtggcattgcacaaccagagcgtcatacagcggcttaacagtgcgtgaccaggtgggttgggtaaggtttgggattagcatcgtcacagcgcgatatgcggcgcttgctggcattcttgaataaccgacgcctttacatcttccgcactctttctcagcaactatcccccactgctctgttttggctatatcaaccgcacggcctgtaccgtggcaatctctgcatcttgcgcccggcgtagcggcactacggcaataatccgcataagcgaatgttgcgagcacttgcagtacctttgccttagtatttccttcaagctttgccacgccacggtatttccccgataccttgtgtgcaaattgcatcagatagttgatagccttttgtttgtcgttctggctgagttcgtgcttaccacagaatacagccattccgaatccggcttgtgattgcgccatccccatagcagccatcacatcagtaccggaaagagagtcagaagccgtggcccgtggtgagtcgctcatcatcgggctttttggcgaatgaaatttagctacgctttcgagtctcatgcgccttctccctgtacctgaatcaatgtgaggtttccgcagaacactgcgccagtatcgatatacatctggttggcaaatttgagtggtttcactgctggcgtatgaccaaagatgaacgtgtccgcgcctttgatttctttcacgatcccgtcttgtgagttgctgattcgttcgcggttccagattacctgctgatgatcaactggctttccaaactcgtatttatcacaaggataatcggcgtggcagatgacatatttttttcctttactcaccagttcgatgattaacggaagttcatctgctttatgggcaagagctttagccagaatttctttgtcgtaatcgagattaaagaaccagccaccgccattaagcagccagtgattgacgtttccacgctctgataagccatcaatcatcatttgctcatggtttccacgtacagctctgaaccaggggaatgtgattaattccaggcattctacgttctctgtaccgcgatcaaccaaatcgcccaccgagataagcaggtcttttttggtgtcgaatcctatcgtctccagttttttcatcaggttcgtgtagcatccgtgcagatcgccaactacccaaatatttcggtatttgctgccatcaattctttcgtagatattcatgcaacctcacttctgctgtttcgcagttttttaagtttctgttgatactccgccttgatggccctgcactcttcgacagtccagcgatagcggttatggtttgattcgatttcctctactgcttcctgcccgatgcggctaatcagttcgacgcgatacggaacgagatttccgcttttgtgctggttgcacaccacgcattgcttgtgaatattgcgttcatcaaatcggagttgaggtgccgcagcagttgtccggtaatgtccggcatcccactgagcagacgtgagcgttccgcacgagatacatggtaagtcgcggtctctttctctgatgaaggcgtgtacggcttgttgggcttgtttaatccagtaactgcggggctttaaggcgagtttttgaatcttaagtttatctttctgtttctgctcctctcgtcgtcgtttcttctctgctgccttttctgccttttccgctttttcgcgttctttacttcgtcgttcgagtgctatcttggttccacaaatctcattacaccaatattgattttgatattttggtataaaccattcattgcaacatttacatttccttcgatagattcgcataagtgctcctttcgttgccggaaaaatcaccgtaatacttatctcgggcttcttcagcaactagtaccgctaactccagatcatcaaagcatccgaagtgtttactcttgccatggaatcctagcctaacattccattttttctgtcgtttgtgccaagtaacccctctgcaacctgatttgctattctttcggatccttatatttcttgaattttctattggcaggcattctcttaaattttctggcctattgtcggtcctaattccattaacgtggtcaatttgaccagcaggccaacgattatgagttatgtaaaaaactaagacgtgagttttatatctacgcccatctatcatgatcattgaataaccgttggaatcaaaagctccagcaacactatttaatgctatccttccctgagtgggaactttccatctaaataccccggtagatttatcgaaacttagtaactcaaatatccttttaacagttaaatcttctcttttacggttacatcgtcttcgcgctggtttagccatcgccttcttcctccgtaatggttttctgaatttggccacctgaacagagctcaccaaagctatggatgtcggtatttccacaataccaagatggcgaaaataactgcatgataagcctcagggaaaagggaagacactacccccgataattcagaaacaaatcgaaatacatgaactaaagaaaaaatcacaacaaatagaaatagaaatagaaatagaaatagaaatagaaatagaaatagaaatagaaatagaaatattaaaacagaccactgtagattcaattggtcaacgcaacagttatgtgaaaacatggggttgcggagtttttttgaatgagacgaacatttacagcagaggaaaaagcctctgtttttgaactatggaagaacggaacaggcttcagtgaaatagcgaatatcctgggttcaaaacccggaacgatcttcactatgttaagggatactggcggcataaaaccccatgagcgtaagcgggctgtagctcacctgacactgtctgagcgcgaggagatacgagctggtttgtcagccaaaatgagcattcgtgcgatagctactgcgctgaatcgcagtccttcgacgatctcacgtgaagttcagcgtaatcggggcagacgctattacaaagctgttgatgctaataaccgagccaacagaatggcgaaaaggccaaaaccgtgcttactggatcaaaatttaccattgcgaaagcttgttctggaaaagctggagatgaaatggtctccagagcaaatatcaggatggttaaggcgaacaaaaccacgtcaaaaaacgctgcgaatatcacctgagacaatttataaaacgctgtactttcgtagccgtgaagcgctacaccacctgaatatacagcatctgcgacggtcgcatagccttcgccatggcaggcgtcatacccgcaaaggcgaaagaggtacgattaacatagtgaacggaacaccaattcacgaacgttcccgaaatatcgataacagacgctctctagggcattgggagggcgatttagtctcaggtacaaaaaactctcatatagattcgtttttctgaccttggcaggttgttcttcagtaggcaaccagtcattgaaaaatgagacgcaggaaagtgtgaaaaccaaaattgttaaaggcaaaactacaaaacaggacgtgttagcatcgttcggtgaacctgacagccgttctttgatcgatggtgaagaacaatggtcatacactatgtataacagccagtccaaagcaacctctttcatccccgttgtgggactgcttgcaggtggcgcagactcacaaactaaatctctgacagtttctttcaaaggcgaaaaagtcagcacatacatctttaatgctggaacaagcaacgtgaagactggcattttttagataaaagacaaaaccagcatcaagggaaaatttagcccgcagttgatacctacgggctttttacagaaacataaatcactttttaaagaaagtgattatctttttcagcctcccccaaactttactgttcatttctacagtctcagtattttcctttaaagaggatcttattggctctggctctggctctggctctggctctggctctggctctggctctggctctggctctggctctggctctggctctggctctggctctggctctggctctggcaaaggagaactaaaatctaatgaagtttcaatattatattcatgatttttatggtctatatcagataatgaaatgggttgttcattcaatggatgatacagacagatcattttcaatgtaataattactatcattatatgagctttcaaatttacccaagaaagccacatatactaatttaaagtggtttgtcttaaatagaaacttatcattttcatccggcatcccaaaaaagaaaaccgtcaagtattttttagcattccttttatctttaagccccttataatacctatcagcttccttcctttgcttttcatattccttccaaaacacatccttctgacttttattccagtcagaaacatcaatttcaagcgtaaatggtttttgggttttcttatcccttgcgaggaaagtaatacaatgtttatctgaatcttcatgcagacgaatattagactgggctacaccataataaatagcaggtttgtaataacgtatgttgtttttgtaaaaaataagttgaaatgtatctttataagatcgcgtgccatatggagggattgatagctgttcattatgattgctattatttatgtaatagtcaacgactggcttaatacttgatgaagatacaggatgttcattaccttttttttcatccttgtgattttcatttttaatatttctggcatttttaacaccacctcttggtttcacatcaatttttaaaagtgatataaccggagcaggtggcgaattatgttttctttcgtcatctgaagtatgattgtttttatatcttggatcatgaataccacatccatctttatgttnatcgccatatctgaaatatgattgatnaacatgtttcatagtaaaactacaaggtgtggctttaattttacaaggctcgtatgggcattcaaaactcgttgtcttaatgtaaaaatcatccattccacggagatcatttccatgaatgatttcatcagtcgaactatccttcgcaatcgtcatatcttaaccctatgaaaatctatgtccttctaaggattctagctttttcttattgacgatccaatcaaaaaattgtactccaacttaccaaaatacacgatcaagcagaagttattaacttaaggggtagaattagtatttttcaaagaaattaaatctttgacagaatgatgctgaataacatcgctaaccttagtaaggtcagggagttgttatacacaactcccctctattatcgtttgttaaaggttctgggtatgtatgcatggtaacagtaaaagcatcttagaggatgcttttaagcattaattagattcatggaattatagatttacgaatctaatattaaaatttagactatagattaagtaagtctaatgaaaatcatacaaacactacaacctatatcttttccttttatcctttttcgataattctctttttagagttgaagcctcatatttccttttctcattagcatagactttctctgttcggctaccattactgactataaagttaatcaatgaagaacatacatgcttcatacgctctttgttgatcaaatcatcatccagtttatttatatgactataatatgaaagtagcagaaaggttaaaacaacctccctgttggagaaggtcattttttctataccactctggtatttgatataaaatcctgcacaaaaaagatatgattgttcgataattcgttgctctgagaaacctgattcagcgagtttatcaacgaatcgatcaagcagaagaagatacctttccattaagttaatatttgttttgtccataatatgcatccttgcaatagtgaaattttgtcgtcctgacaagaaaataaataacataatatttcaccatgtcaatagctaaaacctatcaattttattaaaggtattttgcaggtaacggattattaagttcttcaatcgttatttgtttaaggtgagcattataaagccatactttgaactgctctaaatagcgttcatttaatgccttcaaagcttcattttctgcttcaagtcttttaattcgttgagaagccacttttaaattagcaggttttacagtgtgtattacaccagatttgattgtggtttttttcacattgaagctttccgcaatccttacatgactacttaaggattgtcttgatggtcttttcccaataaccctgactaacctatcgcacaaagcattccaggttagtttttcatctatagaccatgtgttaataacatctacaatcttcttctcatgataaccatttatatgcttagccatttattctcctttttttatttttttatggaattcataccatttatcagcatttatgttcccatcatttttatcatacagtgttctttttaaaattttatcgtggatatttgaaatcgtttcgttatctaaaccagagttcttaattggataattatcacacggcttaaacgcatatgagtgcttgcagtagccatgttttgatacaagtactgcaccactactaagtgagtcaaactcattaagatccactactggaatatcctttattctgtgctcattaacacatactgataactttttttctcttattgctttagacatttgaagatgcgatctgtggtcataagaaacattttgagaaataagcttacgtccagaccagcgagcaatactaaattcatccataccatttattggagcaaatgtgttgagaagatgccttagttgatgtgttnttagcaaatatgggctaccatcttcatttatataaccatgtcttttaaaaacattaaaatacccttttatataatcagaatcaatgatatcagttttaaaaaaattcgttgtaggtctgaataatttatctgacatttcctttttattttgatttaactgtccttcagttaacaagcaaagcgcattagaatatttgattttcttctctctatcataccaaaagagatcaggaggtatattttctttaaggttcccttcgttgaattagagtaattcttttgaatttcagcagccaataacctcgcttgacttgataattcttttaatctgctaatagcctttttagctacaggtatcattaaagttggaatccattttatattgccttcatacccttttgctgaaaaaaatcttaaaccgtatctttgaatgccctttccatcacattctgtgatttcacaatccgctggcaaagctaaaatttccgatatcctactcggtgcacacataagtaaagcaagcacagatgtagtaaatatatctcttgacgataattgttcatcccgctttgaaaaaatctcagcaatcgcaataactgatttgatatcaggcaatctagaatggccttccagtgaagaatcataaccagtccaagactgagtaatcctatacctaattggatttacccaaaataaataaaatgagttagtcatcctattatcatttaaaaatgaactcaatttctcaagttctttcccaatagcaaatgcatgtgctttagaatacttttcagaggctatccttatgcattcatcatagattgaattgttgcaatagtttacattagcttccatattgattttaagtaaaacgaattcgacaatcttcaacattgataatgttgagtgtttcgtcttagatttattgaatgaatgcacatgcaacatatatgctttagcaaaattaataaagctatcatctaagcactccttgctgtttaggttgttttttgagttaaacttagtaaacctatataaacctttccatttattgctttcccatgaagttgttaaattattattagaaatagtactcttacaaaactcgataaacttaataacattatcgagagggttgtttttattgcttggttcaaaaataaatatattgttcataatgctctccagggattgaattttttacacgttaaacatttcaaatcctctttcgtatcttccaataagaaaaatgcatctgaaacaaacttgataaaaaagttcttgttttcttcaatctctatgcccataagtatattagataaggggttaaaaaacgcacttagtctcttatcgatgtcataaacgttgtcaggattattttttatatatattatagaagagtttactgatttatgatctaacgctttagcaatcacctcaattgaggctccttcattagccagtcgacttcctaacgtatatctgaatcttctagcattaagttctatatagctgttagtcctttctgacctaacatcgaattttgacggaaagtgttttaatagttttgacataactgaatttttcatatggaaaaaatctgttgttaaatcatataaaaaatcctcaatcctttttgtttccgtaatcttatctaaattcatgaagattggtaattcgcctctatagttactaatcccaacacttgaatttatcttcaacaaacgcctgattttgattaattagcattgataagctgtcatataagaacggctctatcataaccatgttaaattcttttctgaaacattttctttgttttacttttggtacattcaaaaagcaccctctctcatttttaatgagatctttagcttttagagatattaattgtaatggccttcttcctgttattgccagcaaaaggatataacaatacaaaaagcattgaattttcttctcatgataaaattttccaacggcgttaatgatgttattgaattccgcttcagttaaaggtcctttatttggatctcgtcttttaactgcatctcctgtttggtttggaatgatttttattttctccagcattctaatggcagtcgcttctaccccagggtaattgagatttttccatttaatgatgaaagccttaattaagtttagtttgtagtttctttctgaacctaaataaacattcaattgatatattgctttgtcatcaatagtatcgatagtcatcgcaccaaaccactcataaaatagattgttaatactttgaatataaaaagaactatattcagacgcatagtaagccaatgtttttaagtagctaagtttcatttttgtaggcattctatctacaactttatgagggtatacgcagttttctttatccagttgccatttcttatctgacagtttgaaactatacctgttcatcttagcaaaaaagatttgctcactttcaatacatttgttttccatactaaactccactaattattttacttactgatttatagacctttaggacgacatccttctcttgttgcgatatatatttatagttgtatctatcacacattattgactcctttgaccaacccattaaataattccttaaatctttccttctattatattctaattcagcaccttctattcctttagaatacatataattccaagagtgccttaacctatggcctgaaagattatatagctctggacttgctcgtttcagtgttgatatcaccttctcataagctgaaatgcttaagggttctcctgcgttttttccgggtgcaatgagccacaaataagaaattatgctttttcctttttgtcattttttctctgctattgcttatgtaatcaaaaatttcacgggctaactcatcagataacggaataaccctttctccagtctttactaatggttgataagatcttccatcttcttttgaatcatgtcttctgactacacttaaagtgttgtctctgagatcaaaatcatctattttaagattgagcaactctccagcccttaaacctaaatttaagagcaaggtaaatattagtctgttcctgacctgtacttccttatggaaagggttttcaatcccgccaatttccaatagacggaaaagcactttgatctcttcttcattcaacgatttttcagatatttcattcatattcaatgaactgtttcttggaatatgtgctctgatactttcaataaatacgtctacttcatactttgcatgaatcccctttgacgaatgaactaatccacataaccacttaaggtagcgtgaaaaaacgtgtattctataactaaaggttctcttcgcaataaacctataatttgtcgattttatatttatgattttttgtctgtcgaatctttgtttcgcatatcttaccagatcatctatttctgcaacgttgagatattttttaagttcaactctctcaattatatcaattcccctaccatccaagaaattactgaaaattagtaagttagttgcaactatttccatcgttgaggccgttgcgcctctatttcttatgtctgtagtaagaaatagattttgatagtaagttggtagattactttttttatcaaggatcaggcatcctcgctctccactactcatgatgaatttctttactttatatcccattttcacctcaaacttaacaaattaatatcactctaacttattaaatatattccaattcaaaataattcaaattttttacaatgaatcttgtttaattggtatatatattaatggcttgaaaaattttatttgacgtcaaataaacaggtacggctagtgggctgtatccatacccgatattaagaaaaccatctctaagccttatagcaaaagctctgccagaaaaaacgtaaagaattacgttaaatatagatttttttaagatttaaactttacaaatctgagaattaatcctcataaataagaagactgtcattttatttcaggcaacatgctttcttgaattttcgatagttaattgaatccattcgtctacttcactttcaatgaaagcaacagagcgcgcaccgattttaacgggggaaggaaaacgattttggttgatgaggtgatagatccaagctttaccgtatccagttcgatgcagaacctctggtaaacgaataaggcgggtgttgtgctgattcatantcgtttcctctgtgccgttttgatggaaatgactatacaaatgaatcagcaggaaaaagaccgaagctgggaacgccagagctaatggaggttggtcttagtcagaatcagcgattttcatcacgtctgaaactctgatctttttcaaatggctgttcttgttgatgaacagattaaactggcgaataaaaggtatactcgccgccttcaaagcaagaggtttgtctgtatccctgatttggtggttcaggcgagtgttgatctcatcatcgtcatctgtatacaacaggcgagaaaggcggtcttctgatatacgtactttatataattttgaccataccagaatgtcgatcatgggaaggagtctgtaattaatgattttcttaatcgttccataaccaaagcgaatagcttccgttacatctggttctatgccacgcactttacgccattgaggaagtgcagcctttagggattcagcgatctcttcatctgtcccgtttgctaggtcgatttcgaccatgacagtatccctgaacaattttggcaaaacttccgatacagggctatcgaggaattctctgttaacagaatactcatcgcttccatcccaaaaaaacagtgagttccgtaatccaactatgctgagttgagccagtctttcggttgtcgtcaaaaagaagtgcgggggctggtaaagagtatcctctcttgtgagatagccgagatgcttttctgtgatgagaaagggctttccagtgaagatcctgtcgatgtagagccttacggcttctgcttcaaattcttcatgatatggtttgaagaacaatgtccttgccagcaattcatggtagaggtgtataagcggaagctcttcgaatccgcgatatgtatctatatccagccacttcttcacctctctcgtatgttcaactgaccagtttttcataacgatctccaacaggcattagacttaatgtatgtagcaaacgtaatcgacatgttaaaggaagaccaatgaaatgagttcagatgccatcaggaagttgaaccaaaaggtttgatattttttgatacagttcgctaacggactattttcaggggtttatgccgttacgatttatggttcctttatagaaccaaaggtaaagtcagaaacagcagttatctagaaaattcaatcaaatagatatctagttacagggacg

SEQ ID NO: 159 - DNA  (genomic), 2077 bp; double-stranded, linear
cagtagtctgacttctgaaaagtactcagtgcgtcaacgccttgtccgcctacaggcctgaaaaacatagcgcatcaggggattttgccctggtcaccagtcttataggaccccgaagcctggcttcggggttattaatttaaagcactgcgcaattgctgtgctacctgtcgcgccatactttcgctaacgatattcgtaaacgagagcaataatcctccgtcctcgcttgagcggatacgccagtcgctaagtgcctgtacggcaagaccagcagcattggctttatgcacgaatgtcacgtcattacctgctagtttgatcaccatctggataccgcctttttgcggcacaacctgaaatccctgctgcgtaagtgcctgctcaatccactgccgtcgctgggcataatgctggcgcattttcttcagatgccgccagaaatgcccctcacggatgaaatctgccagtgtgttctgccacagtacgggtacagcacatggttccagtgacgcctgctgccggaattgcgaaatctgctccaccggcaccaccagccacgcacagcgcaatgcaggaaatagcgctttgctgaatgttccggcataaatcacccgctgcggcgcgtcgagactttttagtgccggtaacggcttaccgtgatagcgaaactcactgtcgtaatcatcttcaataatccatgcctgactacgctctgcccattccagtatctgatacctacgcgctaaagagagtgccacacccagcgggctttggtgtgccggagtaatcagggcaaaacgcgcatcaggataattttgtattccgcttgtgacatccagtccgttgtcatcaaccggcacaggtaaaatttccacaccgtggcgagtgacaatcgggcgaatcagcggaaagccgggatcttccatccacatcccgtctcccggttgcgccagagcgtgcagaattaaagccattgaggccgcataaccgtgagtgataaagacctgctctggctgacaatcaatcccacgtgaaacgcgtaaataatcaacaatagcctcgcgcaaggccgcctcgccgcagacatcgcctaatgccaaatcaaagcgcgtctgggtacgcagacggcggcccatcacccgcgcccacaattcacgcggaaaaagatcaagtgcaggtagccccatctgaaaaggcagcggctgctgactttcaccagcaaaagccacgacatccacagcagactgttgcggatgtatctgctcactgacaaaggtacccgcctgtccccgcctgaccagccatccctgcgccaccagctcagcataagcattttcgacagtggatcgagagacacccagctcctgcgaccaggtacggctcgaaggtagccttgcgccaggtttcagttttccttgctcgataaccgtttttaactgacgggcgatatcctgataacgtggcatatggtctgcttttttaggtaatttatggctctctttagcagtccattatagtgctacattgcgggcgttaataagaggagaaactgtatgactacattacgtcagccttactacgaacttagcccggcagtgtataacgcactggtgcaggccaaaacggcactggaaaatagcacgctggataccacgttgatggagttaatttatttgcgcgtctcgcaaatcaacggctgcgcattttgtctggagatgcacagcaaagcattgcgcaaatccggtgtgccacaacacaaactggacgccctggcaggctggcgcgtaagccatcattttgatgaacgcgagcgagcggcgctggcatgggcggaatctgtgaccgatattgccagaacccatgcggaagacgaggtttatcagcctttgcttgagcatttcagcgcagcagaaatcagcgacttaacgtttgccatcgggctgatgaattgttttaaccgtctggccgtttccatgcggatgtaatttgctgttgccgggtatgcgcccggcaaaaaaacacaaaatcccctaccccgttgagccattcaccggtggcgtaatcaatctaaaat

SEQ ID NO: 160 - DNA  (genomic), 40 bp; double-stranded, linear
aatccatcttaaccatcatcactgatgattacggagaata

SEQ ID NO: 161 - DNA  (genomic), 2936 bp; double-stranded, linear
tgaggccgggtaaagcaaagccactacccggcactttttattagcgcttaccttccgccagcagcggcgggatgctcggcaccattggcgcgtcatcaatatctttctgcgtcatgcggaacgcttcgggataatgttcgcggctggtacggcgcagcggttcggtatcgcgccaggtataaaggcaatgctggcactgatataccgtccagacatctttcaccggcgatttcgccatcacttcaatctgttcatcggcacaacgtggacaaatcatcttgttctccttatttacgtgcggccagcatagcggtcagtttttcagcccaggctttggtttccggcaaatccaccaccggctggctgtagtgaccacggttgtccggggcgacaggcgtggtggcgtcgataatcagcttgtcggtgatccccgccgggcttgagccagggtcgagttccagcacggacatattcggcaactgcaccaaatcccctgccggatttactttcgaggagagcgcccacatcacctgcggcaggttgaacgggtcaacgtcttcatcgaccataatcaccatctttacgtagcccagaccgtgcggcgtggtcatcgcacgcaggcccaccgcgcgggcaaagccgccgtagcgttttttggtggagataatcgccagcaggccgtgggtgtacatggcgtttaccgcctgcacttccgggaactcggctttcagttgttgatacagcggcacacaggtggctggccccatcaggtagtcgatttcggtccacggcatgccgaggtacagcgattcgaaaatcggcctggtgcggtaagagactttatcgatacgcaccacggtcatgttacgcccgccggagtagtgcccggtaaactcaccgaacggcccttcgatttcgcgtttgcggctttcgataaccccttcgaggatcacttctgaaccccacggcacatcaaaaccagtcaatggcgcggtggcgatcgggtacgggctttcgcgcagcgcgcctgccatttcatactcagactgatcgtatttcagcggcgtggcgcccataagggtgatgatcggatcgttacccagggtgatggcaatcggcagatcttcaccgcgctcttccgctttatgcagatgcagggcgatatcgtgcatcggcaccggttgcaggccgagcttacgcttgcccttcacttccatgcggtagataccgacgttctgcttgccgaagttatccgggtcgagcggatcgcgggaaaccacgcacgctttgtcgagatagaaaccgccatcaccgtcgtttaaacgaaacagcggcaggatatcgaacagattaatctcgtcaccatcgacggtgttctgcgcccaggctggattggcgcggcgctccggggcgatcgggaagttatcccagcggcggataaactcatcaatctgttttttaaccggggtgtttggcggcaggcccaaggaaatcgcgtggttctgccaggaaccgatggtattcatcgccacgcgggcatcggtaaaaccgcgaatattatcaaaccacagcgccggtgcaccatcgccgatacgcccggtggcgttggcagcggcagccagatccggttccgcgttcacctcttcgctgattttcagtaactggccgtggtcatcaagcgcctgtaaaaagctgcgtaaatcatcaaatgccattattcattctcctgagaaaaattccgggcctgcggcaatccttgccagcgcctggcgtagggatgttcaaggccaaattgatccagcacgcgggctaccacgtggtggacaatgtcatctaccgtttcgggatggttataaaaggcaggcatcggcggcaccatcgccacgcccatgcgtgaaagtgcgagcatattttcgagatggatggtgctaagcggcatttcacgcggcaccagcaccagtttgcggccttctttaagcacgacgtccgccgcgcgccctaccaggccatcagcgtaaccagcgcggataccggcgagcgttttcatactgcacggaataacgatcatgccgtctgtacgaaaggaacctgaggagatggtcgccgcctgatccgccgggttatggctgaagtcagcgagggcagcaacatcgcgggcgctgtaaggcgtttccagttcaatggtggttttcgcccacttcgacatcaccagatgagtctcgacattcggcatctcccgcagcgcttgcagtaatgccacaccaagaggcgcaccggtagcccctgtcatcccgacgatcagtttcattgcttactctcttaattgttcgtatacgaacattattattaaaatacgcctctgttctcattgcggcaagcactgaaaagtaacaacatccccttcgtcactgaaaaaccgctatgatagcggcagatagtttgcccggagtttacatgacgttacgaaataaagcgttccatcagttacgacagctttttcagcagcacacggctcgctggcagcacgagttacctgacctgaccaaaccacagtatgcggtgatgcgcgccattgctgataagcctggtatcgaacaggtggcactgatagaagcagcagtcagcaccaaagcaacgttggcagaaatgttggcaagaatggagaatcgtggcttagtcagacgtgaacatgatgccgctgacaagcggcgtcgctttgtctggctgactgccgaaggagaaaagatacttgctgcggcgataccgattggtgacagcgtggatgaggaatttttggggcgtttgagtgcagaagagcaggagctgtttgtgcagctggtgcgcaagatgatgaacacataggatgcaaattgccgggtaggacgctgacgtgtcttatccaggcgacaaaaacacaagcttcccaaacaaaagaa

SEQ ID NO: 162 - DNA  (genomic), 9179 bp; double-stranded, linear
gcggcacgctggattgaacaaatccctgggccggtttatccccgctggcgcggggaacacaaaccgaaacacacgatcaatccgaatatgagcggtttatccccgctggcgcggggaacactttggtgacagtttttgtcactgttttggtgacggtttatccccgctggcgcggggaacacactaagcatacatatctgtttttaaacaaatttattccacatcaacaatctaccaactaaattcaaacatttccttatttttaaagaacacataacctattgattatcaacaggaagaaaagaaaccaaacgtaacccatccaaatccaccggaatacgtctgttttctccccaggtctgaaattcaaaacccgactcggtattggtcgcccaggccatcaccacatttccgcaaccagccagttgggtaatttgctgccagatcatctcccgaatacgttttgatgtatcaccaacatacacaccggcacgcacttccagtagccagattgcgagccgtccacgtaagcgcggagggacattttctgtaacaaccacgaccatgctcatccgccgcgcccccggtgaccactatcacccagcgtttcaggttcagggatggcaggcggtaacatatccggcgcgggttgtggtggttcaatttcacctgcagcaaggactttctcaattaacggtattaatttgcccgttaacttagtgctacggaaaatatcgcgacaggctaatctgacttctttatcaggttctgcgggttgcctcgctgctatttcaaatgcctttggcacaaccgaatcaaatttaatgatatcggctatgtcataaacaaatgaaagcggtttgccactatgaataaatccaatagcgggcgcatatcccgcggctaatactgccgcttcagaaataccgtacagacatgatgtggcagcactgatgcagcgattcacaacatcgcctttttcccagtctttaggatcgtatttgcgaccattccatttcacaccatattgtttcgccagtaatgcataggtctggcgaacgcgggatccctcaattccccgtagctgatccactgaacggcgagctggcggtggctcacgaaaacgtaattcatacattttgcgcaccaccttcaggcgtagatcttccgttaaagccagctttgcctggtagagtaatttatctgcccgcgcccctccgggttgtccggaagagtaaacgcgaacgcccgcttcaccgacccagaccagcagtgttcccaccgtggcggccagatgcaccgccgcgtgggaaactctcgttcccggttcgagcataatgcaggcgaccgatcccaccggaatgtgcgtgcggatcccggttttgtcgatcagcacgaaagcgccgtccagtacgtcgatttgaccgtactggaggaagatcatagaggtgcgatcttttaacgggatcggactcagtggtacaaacgtcacacctctgctccgggtttgatcagcatcagaccacagccgaacgcgcggcttttgccatacccctgactgagacgttgcagaaataacccgggatcggtgaccgtaagcatccccgtataatccacgctactgaactggatcagttgccgggagttttcccgccgcagttgctgttgtcggtaggcatcaaccgaggtatccagcagtgtaaaaccgcttctctccccctgcgctgccagccagtccagcgccgcctgttgttgatgcaaccagacatcacttccttccgcctgccccctcacctgccgtttcgcctccatcagcagatcgtggcgcttgcccgctttacagattgttggattcgcccgcaggttgaaacaaagttgttgtccggtacgcagctcgggcacaaatgaccggcattcgatggtgaacgtttcactttccgccgggcgttcctgcgacagtacaaaaaagcgaaacgcgccctggagttcttcccgacgataaagaaattgcctttctttgccgccagggaagagatcccacagccactgatgcatcacatattccccgcgatccaccaaatgcagcaactgcgcaggcgaaagctggccggtatgtaaggttattcttgagaggtacatggttcctccttgctgagccacggcccctgattgatggtgcgttccccaaacagccactgctgacgatttaaaggaacatcccggcgacgtaatattttgctcgcgaccaggccgtcgtgttccccttcccaccagcattcatcctgaagtttcgggagtgagactttcagttcgcggaaactatcctgatactgttggtatgcgttacgtaagacatcagacgcgttgccttcgagcagtaacggcgcaagtggtaacgccagcggatgactttttcgccccagataaagcggaaaaaccggatgacgtaaaccgtcctgcaactgttcaaggctgtaaggcgcatcgggggttgttgccaccgccaccatccaccaggcatcggtgtagtagtcgcgccgggagataatcgcgctcagaagatcaggggcgctcaactcttcgcgacggctgaaataacgcgctttacgcacctcttttggcatctggaccgtgtgataatcccgtgcccagcgcgggttacggctggcgcaaaccaccagtgaatagtggcggttaaacgcgtttaatcgttcggtatcatcacgccgaatccctaccccggcagccagcagccccagcaatgctgagcgcgaaggcagttcatgggtatgacgcacttcgccgggggcatcgacgccccaggatgccattggcccatgaagctgaaaaatcaaatattggctcattagccgccccttacgcgcagataaagtccagcacgtccttcatgcttccctgtttgttcatcacgtcaaagcttgcgcattcggtcttctgttcatagaccgtattcatattttcgcgaagcgttgtaatacgctgcaccgccacatctaactgccgggtgccattaatgggttcatagaaagccgccgccagagaacgtggttgttcggtgcctttttctgccagcgcccaggaggcgtaggcacggctggcaaagctgttctgtttgccggttggggagactttaagtgcggcttccgtaaaggcgcgcaaggtctgattagctaacgcttcgtcaccgccgaggttttcgaccagcagatctttatcgatgcagatataggtgtagaacagcgcagaaccgaatccggtttcaccaagatgcccggcaccggcatcttcagaagcctggcgcaaatcatcaacggcggtgaaaaaatcatcttcgacaatcgtttcactgacaccaaatgcatgcgcgacctggcaggcggcttcaacattaaattcgggtttattcgccagcatacgaccaaacatagcgatatctactgccatgcgatctttacgtaacaaagcgagatcttcctcttttggcgcgcgcttttcttcggccagttgatgggccagcgcttttacggcgtcaaattctgccgggctgatatggactaattgttcagtttcggcgttagtgagcggatcttttggttttttgtcgtttttagctttcccaagataatccgcaatttttgccgcccattcgatggcttttttctcttcgatgcctttctcaatcaggatagttgccgcctcacgcgcaatacgcccactgcgaataccaatatggcccgccagtgcctgttcaaaaagtgcagaagtgcgccacgcacgtttcagactttgcgaggaaacgcgcagtcgcgttgctccacccaggaccacggttttcggcgctccggtgtcatcacggttaaggttggctgcagggtaagcggttaacaaatgaagctgaataaatgtcgtcatgagatagtcctttattgattttgttcgttatcgacgtcgccagcctggtaatattccagcgcccagcggatacggataaattcggttggccgctgatgacggcggtgatgattgagcagatcgtcgctctcctggcaccagcggaagacaccctctgccagagagtcaagattaacggaaccgtttaataatctgactacgcggcgtaactggcgcagtaattcatccggtgtttttactgccgacaggcgagtaaaacgcccctttgacattaccgccgccagctgcgcagcaaaaggcagccgttcatcaatggctttaacattagcgctaagtgcggctatcagcgccagtgcggtaatacgccattcaggttcatcctgccactttatttgtctgttcttcagaaacaggcgaaatccatccgtcagacaaacatcattaaccgtcgtactacgccgcagactggcacgttcgccgcgtttctcctgcaattcctcatgccatttgcgcagcgtggctttgtgctcctcttttacaatactcattcagcagcctcctgctttttctccctggcggctttagcactttgcttctccgccgatgttgtaaaatatttcttgcgcgcggtcatgacgcgttccaaatcaacgggctcataaggattggtgaatacacgctcgtcaaaatcctgacgtgcgaataaccaaatttccttttgccatttgccgagtaattcatccgcatcctgaccttcttcaatttggcgcactaacctcaggaagcgatgctgagttttgttccagaagtcgatatccacaaaactgaaatcaccccttgcaccttttggatcggagaaccatgcttctttcaatgcactccgtaacagactcagaatccgtgaagccgtttgcgcagccagccgcagcttcggtatctggccttcttttttattgagcagcagcgggaaatggtgttcgtaccaacagcgcgctttcatgttgtcgaaatcataaccaaatccccacaggcccacttttgcctgtttcagactgctggcattaaagagtttcaccaccagcgcgggaagttccgtattgttttctgacttacccgtttcgataaggcctaaccagtcgcgccagattaaaccgcccggttgtggtttaacggagtaaaactcaccgccctctttaagtggtacacggtaaggcgttaagggatgctgccacatggcataattcgcaccgtaatttttggtagtcatcaaactcagaagcgcgtcactctgctcaccgcaaatatcgcagttgccgactgtcgtggtattaaaatcaatacgaatacgccgcggcattccccagtacgcctggagtttattgacctgatcatcggttaccaccgcaccggccagttcgctggtacgcgtcgggccaagccaggggaaaaccagatcgtcaaattttttgggtagcggtaagtcggcttcatcctgcggcatcacgttgagccacagtttgcgccacaagggggcttgttgattgccctgatactcctgcaattcaatcagagtcgtcatcggcccaccgccgcgtaaaccggtgcgatagcctttgccacctgacggcgcatttaactgtagggagaacagagctaacgcagaacaatgagagcatacgtgttcagtcacgccacgcttaataaagtggtctttattaaacttcgttgtttgagcgccgggaatctcaggcagtagcgaagcgacctgaactttatcgcccatgagcacctcgaaatcctgcataaatgaaggtgaatctgggccaaactggaaagggtgttctaatgacagcaatgcttcccgtagcttttcagcttccagcccgtcttcccagatatcatcccaacgacgataatcttttggcgcgaaactgctttgtagtaaccccagcaaaaactgccatgccgccccctggagatctgcccgcggcgcagcgatatcgacaacattttcatccgccagatcgactggcgccagcttgcctgttgttccgtctttaaaacgaacgggcaaccacggggttgtcagaagtgaaaacgagttcatatgtatcctctcgtaaaaaagaccatccctggtcggttgtccatcattccatccttttcggtgtatcaactattcagagagtcctgtcgcaggtatctcaatcaaccttgccaatcaatccctccctggccgaatacccgcaactttcgtcatcagtgactaaaatcacgtttgccatttccggatcttgccgctgttcaatgcaccactgcctgaacgcttccccttccagtaaagaaaactcatcccgatgttttttccaccagcttcgacgcactctgacaacgctcatttcccatgcgtgagcaccggtggcataaggcttcaccacaccggcaatacaggtagccagccacagggaaacagattcctcagccagacgtgtcgacagcttttccggaaggtaatcgttgatattggcggcatagccaggcttgaagttcaggacaaactttttagccattgcgcgatcgcagtaatatttgcccacttgctcctgctcgctgcgggcaaatccttccggcattaccacgtcctcaccgtagactgattcaataagaaggcgggctgcgtgtggcatttgaatagcgccttgctcacgcagtacacgctgcgtcagccagattcgtccatgatcgggatagacatatgcactgttacgcatggcactgccgaaccattcgtcaccaggagcgtcgtcccagacgggggccagaatcagcaattcaggaggggaacgctcgtcttttccgtcacgctttaactgaccattaatatcgcggatatgccgctgtaatcgccccgctcgctgaatcagcaaatcaacaggggccaggtcggagatcatttcgtccaggtcacaatcaacgctctgctctaagacctgagtacaaatgaggacttttccggcacgctgtgaaccgtcttctttaccaaagcgtgccagcgtctccatttcaattcgctggcgatcgctaaaagcaaagcggctatgaaagagtgaaaggctggaagcgggaatgacgccgcgggcaagcagctgacgatgaaccttaatagcgtcatcgacagaattccggatccaggcgatgcattttccctgacttaccgccgattcgatacgcgcaatactctcttgttcactatgaagccaacccacgctgacgctacgctcaacgtctttgcgcgtcgctacccggtgtgagttcacatcggatttcgtgacatgcgtcagccaggggtaatcatccttttcaaggaacggagcttcttgctggccctctgtgccacgcgcaaaggcggcgacgagtttgtcgcgctgctgttgggataacgtagcagaaagcaaaatgacgctgtttccgccacgcgcctgccgctcgatcagcccttcaagaatgcacgacatgtaagcatcacaggcatggatctcatcagccagcaggattttgttactcaaccccagaagccgcagattattatgtttaaacggcatcactgccatcatcgcctgatccagcgtgccgacgccaatttcagccagtagcgccttcttgttactgttggcaaaccaggccgcacatccctgactgaatgtttgttcatccggttcttctgacccgactaaatcaccggaccagagtgattcattgaagcggtccattaatgtgcgggcactgtgtgccagcaccaagctggggcgggactctggcgaatagaaagcaagccaggttttgaccagccgatcgtacatggcattggccgttgccattgttggcaggccaaaaaacaaaccctgtgctttcctcgcagccatcaacctgtgcgccaggataagcgccgcttctgttttacctgcgccagtcacgtcttccagaataaataactgtggccctggctggctgatatccagatccagtaccttttgctgtaatggtgtcgggtgctcaataaaaggaaacagcgtattaattccggtgaaaggtgcggtttctgcttttggaggaaagacggttaaggcgttttgagcctgaactaaagttttctgccagtaatctttaatatccattgggtgtgcgacgcgtggaaaaaatcgcgttgacgaacccgtccagtctgcgagtacgactgttgcagagatataccaggaaagttgttttaaaagttcaacgccctcgtcatcatcccagaatgtgggaatctctatgagcggaaacagtgccttgatttcaaggagaaaatctcgcgcggcagctttgtcttcaggcagaaaattatccagctcatcaatacggtcaggtggtcgaccatgatgcccggtagttatggacatccacatctctattacacgtgtaagtttacgagaagagagtgaagatgaaggaagcaactcctcacattcacttaaataataattccacagccagtaacccagcgttgaatgagagatcttttcgtaattctttctggaaccttccggaatcttgagttcaggggccaggtaaagttgctgaaaagagcgggcaaattttccaatatcgtgccagcacagcaaccaagcgaaaaattgagccgcctgttccttgtcagaaatccctaattgacgaaagtaatcagccagcccgaagcaatttcttttaaccattaaatagcccattgcggccacatccagcgaatgccagcaaagaaggtgatagccgtcgccaccctctttctcgccacgtcgggtttttccccagaaatcaaagaaagtcacaatatttttatccttcagtaaacttaaaggatatttacgcatattttaaaaattatctgtgatatatatcagccaataaacatttatattatgaataaattaatgattttcatttgaaattcataatgataaatagagactatatattcacataaaaaatataaatttaaaaaagggtacaggagaccaaaccatcacaattcaatacgcggggttttacccccgcgtggtggctacttcttcgattcgtaagcgagaactgccttaaactccataccacgctctctgatactcaactcacataacgagtcgcctaccatgagcgtgaatcccagtactgtacaacacagtactatgattgccacaagggcatattttgttagc

SEQ ID NO: 163 - DNA  (genomic), 32 bp; double-stranded, linear
tcgactttaattttttcgctgcccgcttttgc

SEQ ID NO: 164 - DNA  (genomic), 3487 bp; double-stranded, linear
aatttatcaggctgtggatataacgatattcaaacctatgatgagcaggttaacgcctcctggtctgaggtattgaatcaatatcaacgtcgcgccgatcttattcctaatcttgtcgccagcattaaaggttattccagccatgaacgagatgtactggaagccgtaacattggctcgtagccaggctaatcgcgccagtagcgatcttcagcaaactccgggagatgaacaaaaattacaagcctggcaacaggctcaagcgcaggtgactcgcactctcggtcagttaacgataattagtgagcgttaccctgagttaaaatctcaggaactctatcaaaatttaatggtacagcttgaaggaagtgaaaatcggattgccgttgcgcgaggaagatatattaaagccattgaacaatataatgtcactatccgcaaattccccgctgtattaaccgcaaaggtcatggattacacaccaaagaaaaattatttgccggatgatgtcgccgcagtaagtaaagccccaacaatagattttagccagaatgctaatgctcattaagcggggaagttctatgcgaaattttatcttccttatggctttcttctgttcatctgtgtttgccacacaaattccagtacctgaatcacccaagtatgtgaatgacttaaccggcacattaacaaacagcgaagtaaacaccctgaccaaccagattaaagccctgacgcaaaaaaactacgcacagttggtcgtgttagtggttgaaacaacaggcgatgaaaccatcgagcagtacgcgacgcgggtattcgatagctggaaaccgggtgataaagaccgcgatgatggagttctactgttagtcgcctggcaggatcataccgtgcgtattgaaatcggttacggactggaaggtattattacggatgcgcagtccgggaaaattattcgcaacagtattattcctgcatttaaaaaaggcgacctggctggtggtttgcaaaagggaatcagcgatattgaaagtcgtctgacggggaataatttagcaacgataacaccgaccgatcaccctttgccctttagcggttggtgggcattgttagtctgggcgatagtactgacgtttatttctgccagaggatatatcaaaacgctgggagtaatttgcttcgcagctattgtactggcctttgttttacctatagcaggcttcagcggaagctggggagtactcgcaacatgactctgcttcgccacaccgttcctggctgtcgccatcgcttttacccccttcggcaaaaaagttcgggatttgatgcgtgatgccaaccagccatcacgccatacaagaagcaattcttcctcccactattcatcatcgtcatcctcttcattcgacaatgacaattttagcggtggtggcggttcatctggtggcggtggcgcttccgggcgctggtaacaaaaggaattgatatgcgtatttttctcttacttctgatgctatgcggttttcaggtattcgctgaacgattgccttcagtgactgacttaaccgggacattaacgacagaagaacaaactgctttaactcaacaattacagactctcgagcagcaaaaccacttccaggtggccgtgttggttacgccgaccacagggggcaaaaacattaaacttgcagcctcgcagagatacggggtatatcactggaaacccgttggagagaagcgatatggcgaaggtatcttaattctcgtcgtatggccggaagggctggcgtcaatgaagattggacatggactggaagagatgttgccgccggaacaagctgcgcaaattgttcgttaccatatgcagccagaattcgaaaaaaacaatctctttgctggattaacgggcggaattgaaagcatcgcacagtttacccatatcaaagcgaaccttagccctttggatgctttagccaatcatctgtttgctaatccgcaacgttcgctgccatgtcttgcctggacactgctgatgatcgttgccatcgttgtcctctggctatttgccagccgcccacggcgtggcatatggatgatatcgatgattacccctatggtctggtttttctcctttcaggacgatgtcatcattcggcgggtatcggtcgtttgttttagtttattgttagcaacaacctgcaagcagcgtctcgcggtagtttttaatatgtgccgcgtatttcctatgatgctgaccccaaaaaataaaaacgctaaagtgaaaaaacaaaagaagactccgcaggttcgtgaatcaggacgaaattcattgtttgtcgtgatgctgataattattgtgggatggtgcctggtgttcgccagtaataaagatattgcattcatctcaacaattattgggttaattgatcattttatcggcccaataaccattgctggcatcgttctgctgatcattgtggccaaatttactggcaatcttaagctggggtcaggagaaaaaagcaacaggaaaacggggaatcgtaatgctcattctcgctcttcgtcgagaaattctttccgcggtggtggcggttcttcaggaggcggcggttcatccgtccgttggtgatcgtaatgcgcttaatctttattctattcactttgtggtgccttcctgggcttgcccagcaaattgctgtgccggaactgcgccaacaggtgaccgatattactggtacgttaagcacttctgaacaacaatcactgacacagcaactgcaggatattacacataaaacacgggcgcaggtcgctgtattagtagtgccgtccaccggagacgattccattgaacaatatgctacaagggtttttgatagctggaaactgggagataagcagagaaacgatggtattttacttctggttgcctgggaggatcatgctgttcgtattgaggttggctacgggctggaaggggtggttaccgacctgcaagcggcgaagattatcagggatatattgatccctgccttcaaaagtgatgacctgatgggtggattaacactggcaagcgaaaatatcggcgcgcttctgttgaatggtgaattaccggaagacaggggggattattacagtatcaatccccctattccattatcgcttgctgtaattatattgctggcggtactttcatattttattgtttttaccgatccgtcgaatttaccctggatcactctcactggcgccatttacgggatggtattcctctatgttgccgagccaggaccatggaccaatttaatcgttgcctgcggtatgttaacgccttttgcgatcgtaccactggttattttttggcttatcgtcaataaaaagctacgcgccaaatacaaaaaactcagtaaagatagagcttcaagaaaaggttcttcttcatcctcttccggtggcggctcaagtggcggaggctcagg

SEQ ID NO: 165 - DNA  (genomic), 236 bp; double-stranded, linear
ccttgatcaaatgaatttcgaatataataaaggaaatcttttgagatatttatcacgaataaagctatttatgttaccaatatcatttcgagtacgcacactatctatctgttttttaaggatataaaaaacaacatgtaagttatgtaaattgccgatgctactaagtaacattatagtaaaaanagtaaaaatgagcgatttttgatagaataaagcatgagaaaaggtgatat

SEQ ID NO: 166 - DNA  (genomic), 16950 bp; double-stranded, linear
tagtaaataagtgaactattcagattaaaatgttcaactgaaagattatactgcaggagaatcatttcattggtaatagatctcagcaccggattgttaataggtgtattattcaagcttactcgttgaggatgaatataactaattggagcatatataatctttcttagggcaagattcataacgttctcatatgtctacttaattttcaacctgactaaattagttagaatggccctatacttccataacagccagcaagtcgctacggatattaatgcaagtaagatagaaaccggcatagccttatcataagcaaaaacaggttcgctaatttcatatgttggtgcttgctcaataatgtctcttcgttttgacaatacaacagaaatattctcatattgtacgcttgcaaaactattaacaataaatctctttatgtcatttatttttatttctggattgatatctttttcatatactgcaagtacagaaatatgaattggtaaagcagttttaccactatcgccagtatcaacatcgtaactaacatgtactctcgaagaaacaataccatccataattttgagagattgctctaaccgctgctcaatagcagaatatagccttgctttttccgctcgtggagatgaaacgagtgcatctgcagggaacatctgcgatatttgaatatcaggcttacccgggagattgtagatttttagccaatccaccgcagaagcaaaatccgttggttcaacatagattgagaatccagttttgccttgatccttcttttcagcattaatattatgtctttgtaaaacagcaaggacatcattagcttgctgttgatcaagatggttcagtaattcctgctgcttgcagccgcacaacagcaggataaacaataataatgatatatatttcatgagcgggtcaacgtctcaactgcagcgacaatttttcttgctaatgttcccaccaatgaaacctcgacattataattaagcacatgatcctgcaagactaataatttttcaggagttaatccttttttatcagacgttaatgcttgtaacgcattttgctgccaattttcagtttgtacagcatagttagcaaaagcggagatcattttatcatccgggttgtcaagattgagaacccggtcatttaaatcaatcactttcgcttgctgtatttcatgagcagttgattgctcagctctatcaataggtggcatattgcttactgacataataaaatccttatccagtttagcggaagttttgtatgattgccgaatcaagatctttatacgcttttacaacgttagattgcgcatttcgatataatgtatactcagctaatgcactttgatattcggcaagggaatttcgggtcggaaggattggttgctaaatcctccaacgctttttcaacttgctgggttcagatcatcaacgcccctgatcaaattgtttgctgatgtccataatataacccattccaatctgccataagtcctcctcaattattcctgaaatgtccacttgctacccttgagacttctcgaatcggttatctccgtagctaaatgaactattatttgtgtcctgatttttcaaattcacattaaatcttacatattgtttaccccattgtttataatattcgtcaacatagttatttattttgtttaattcactgtcgcttaacgtaccaatgatattgaaatacacattgttagctgttttatatttttcataagaaagacctattgcagacaatgtttcaatagcctgactttccaatacattatcatctaataccgcaatacttatattgctggcatatggcatagtttgtagtaacccctttaataagattgtcgattagttgctggtgtgatagcattccgttgcttactcacggtcagtctgggattactggcatctaatagctgaagtttaaaatattgtaaatcagggaaattatcagcaagccatgaaaaaattcgtatcgattcatcatcaggatttatcacccgtactggctttcctggttgatttttttccagtgcttgtttgacccagactgcttcatccaaactattggtattgatatagatgacatgatctctaccatataaaatttcataattcctgtttttgtttacaagaatcttatcgatatgtctcagctgcggatcattactggcattaacaatataaaaagcaatgaaaatgataacaaaaagaaaaaaaagcattacatactttaacagtttactgctaaagaaatgttgttttgtagaaataatgctattttcaataatgcctggcaatgaatactgccaaacttcattttttcttttacagcaaatttgagacctaaaacttctatttgctgattcaatgttaacgttctatcttcaggttcttgtgctgttaattctctgattgttacaaccagatcagggtcggtagtgattataatctcaaaactacctgtaagctcgccataaggaacgactattgtattttctggtaactcagaaaaagcatcacttcttcctaacgaaacatcattaccaatgataacaagtagacgcccattaagtatttcatactcgcatccattctatggtccgctcaacaaacgaatggcataagattccaataagtcttgtgataagaatttatcattattttccatgaataccacccgctaattccataagctctagtttagagtagtgtaacaagacggaaatttcatgaccaaattatgatgagacagaataaaaaaattataattttgaggaccattttaaatgcctctatgcataactttatttacaatttaaggtataaaccctattccctcaacgttaagcaaatataacaattactcttattttaaattttacacataatatttaccctaaatgattttagagtacaggttggcatatgcaagtcttttccagtgatgtctacttcactgtaggcactaatgcattattagcatcccaaaaggaatattacagcgatttagttgcgttggttgatcttggacattcgttcgttgttattgatgagcatcaacatcgaaatctcaaaccaaatacagaacctgtaaacatccttttgagtaacaatttcatctggatcaataagaatattacattatctgatttaacgcatttcctggtttcaaatcttcatacacaaaatgtgtattccacacaagaaccacttacccatgatgagatagatatcctgcggttatgtgtttcatattcattaaagcaaattgccattattaaaggaattgattataaaacagtatcatatcacaaaataagagccctcaatcaacttaacataaaaggtactgttgagttgtttatagcactctgtgaatgggataaacattattttaaactccaatcttgcgtaagagaaagttgatatgtcattagtaatgatataatagtaaaatcataataaccatcgcgctgatatcgttgctctctgcatgcaccagagaaaattcattaaaggagaatcaaaataaaagaagtggcgaatcccaagcgatagtagatgcaagacagttctttagcgaacacccggaatatatatcatcagcagaactggaggaaaagctatatcgcgaatttgcacaggttactacagttccagcttataaagagatgagtatgtatcaattgcttgtcatttcgcaagatcgtttaactcattaaataaaaatctacacgttttttgcgtgtagattcttataaatttttgactacgatacatgtttaattttttaaattattgtcattattctcgctttttgtgtcttcaccctcaatatatttatcttctgaagagagctgttcatctggaacaggttgtccagcattctccacatcttcaagccacagcagaagacgtaatatttcatctatattttcgaagctaacataatcgtagcgacgatgggtagcataaatttttcgtgctaattttttatctgtaataattggtatcccgatttcctttgcatatttccttacagctaatgctacctcattagtttctcttacagaaatcaatggaataggtgacagatgtggcttaaagtatatccctattgcaatgtgagtagggttggcaatcatcaaacggctattactgacatcagatttcaattgctcagaaagaatttcctgatggcgctctctgcgtttagacttaatttcaggatttccttcttgttccttgtattctcttttaacttcttgtttatccattttcatatctttcataaataaaaaatattcagcgataaaatcaaaaattaagacaattatcatactgccgagacaatacagtatgagaaggaatagcatctctccccaatctgataataaagatatgatatctccatcaagagttttaaaaagcagtgatttatgattactccaaaatactttgatctccaatgcaaaaaaaataatataaagaattgctttaacaaattcttttacggtttttaagccaaatatacgctttaaaccatttactggattcaatgaatcaaactttaattttacagcttcagttgctaattgcattttactttgaaaccaggagacaagtattgttgtgaacatgcaaaccagcaaaaaaggaatgatcgttttcaaccaaccaatccccatagctttaaaatagtcccaaatatccggtttagcgttatgatcaaggatatattcaagaatcgacataatgtgatgcacatcaaaaacatatccgagatataaagtacccacaagcattattacagaaacggttaagtctctactttttagaatttgcccttttttagaagcatcctgcagtttcttttgtgttggcttttcagttttatttgccatgaaacactctatttctcaatgtatagttgcaattgttctgggaaaaaggataacggcatcactcgttcagccagtattgggccaaaataaataattaatattaaaaatgccagcgcacttttgacagtcagtgaaatggcaaaagcatttagttgtgaagcatagcgtgccagcaatcccaggacagcctcaccacccagcataacggcaattacggggcttgcgtaaacgatagtatgagtcattatattattaatatatgaaaataaaggctctaatttaggaaaattaaaacttcctgaaggccataaattataactttgctaaagagtttccagaataaagttcaatccaccgttagtaagataaaccgctgcagagaaaaggttaaataatcttgctaattccgaggtatcgacacctgtagccggatccaaagtactacttaacgttgcaccgcgttggttatcgataaagctacctatagcaaggaaaatccaaaatggagatgctaataagcaagcaatgaacagccctatgataatttctcttgcagctaacaaagcgatatcgatttcatttaaggtcgataattcatagtggtaatgctgaactaatgcacatgataccactattattattggatgacggactactgttggtatattcccactggcgaaaaatggtaacaaatagaaagttggtgccaatcggcaaaaaccgagcgctgtagcagccagtagactatgcaactgatagagtatcacctcccccatgctatcctctcgcaaatgctaaattcagcatttcaataccaaaagaatataatttttcaccataccatccgctcattaaaaaaaagcaaatacttacgcacaataatttcacgccaaatggcaacgtctgttcttgcaactgcgttaccgtttgaaaaagccctaccaataaaccaacaaatgtcgctactgcaataggtcctgcagacataactaaaatcagatacagcgccctattccctgcaaaaacaatgtcatccatatttttttcctcagggattaatggataggtcaaaatattgtaatatgagtccttttgataacattgtccaaccgtccatcgcgacaaacagaattaattttatcggtgtagatatggttaccggactcatcatcatcatacctaacgttaacagaacgctggatataaccagatccactacaacaaagggtaaatagatataaaaacctataataaatgcactttttatctcacttaacgcatatgccgggagtaacgagaaaattgaaatattatcatcatcgattatctcttcattgtcttcagaactattcaccttctgaatcttttcaaaaaagctaaccaactccggttcagaatattttatcaaatatgatttataaccactcatgcctgtctcaacaaaattaacaaccgacgctacattattgaatgaaagattctcattctgactgttataatatatttccttcccaaccggcatcattacaaacattgacaatagcaaagcaaccccattaagtgtcatatttgatggcacttgctgaagtcccaatgcgtttcggacaataacaaaaacaatcgagaatttaataaaacatgtcccggatgctattataaacggcaatagtgtaaataatgatagtatcgctatcagcgaaatgctatttgacattattatgccctgataaccaagaatgaatctctacgcccaatttatcatccacttcaacaagttcgccatagccagttagcgcgccatttacacgtatctctatatttttctcagattcaggaagcagagatattattctttttgcacagagctcgtctatttcatatagattcattattttcttaccaagaacaaactcaatttttacaggcaactcttcaaaactattaatcatctgttcgtcattttcatcataaatctcactctcgctttttttgatatcaaagtcatctgtttcaaaatcttcctcgtactgaaaatgatcagccatttttaactcctctggataaattaaatcacaaatctttgtattataaataaccgcataagccatattatttgagattaataaaacatcaccgacttcaatatcaacaatagttctataacatgttttactaaatccaattacaaaatgaatgggccaatataatgattttttgtctaaagttggagcgttttcgtattggcagactgtgactttatctaaccaaagattcaattcccctgtccatattcttatcagtggttgagctggactcaatactccatcaaatactttacctacgcacaaacgattatattttagttcaggatactttagatttaacggggaactggataaactgagccattcccctattaacctttccgtttctggcattaaagccatcccagcgagctcggcagaaattaagggaaatatttctcgaagcaacacccatccagaccagctgccactctcttctgctatcggtagccatttagcactaaattcgggcattaataatgcaacatcttcgccattttctttccaattttgaaaagtggtttcaaacgtagagtgtttcgatttactttcctcagaccgaacattaactttcatccttctgatcgttttcgaatttgccttcattttcttgctcctcatgaggctgatgtcgttgtccttgtcgttcatcttgctcagtcaatacccaacgttgtgctgtaacatcattgtgttgggcttcatggagtctgtcggagacaagtgtgtctgatggttttagtcgtatcccttcactactttccagaatccggaccgtatgattttgtccccaacgctgaaactgatatgtcaattcattttcgcgcacattggcattattagcagaattatttatatcattctgattgagcgtattaacattcctttgcttttcgatatgttgagtaaacatggttctgttatcagcaaaccttctttcgttagtaatgtctaatgaatgggcctgcggtccatttattttgtctccatcgcggtattttttttcacgatctttattattactgtgtttttgatctgtgatgtattctgtatggataccattatggattttttccttaaattgtatcgttcgattagatagttcagaattaataccctgatctcgtgaagtcatattgagaagtttctttgtagaaaattgctcggctccttttgtttgcaaagaaagagatggattcctgtcaacctagagagacgatttgttgtcaatagacttcatgtgcccattctttttccccaacgtagaaaattggttatcctgagtctgacgtaataactggagaatggttccagcgacaatctcactcatttctttattttttttgtttttctttaagaaactgtctaaatccgaagcagaattatcgggtgtgtctgtgtttaaaattttacaatgttcaattttcttgacttcgtccattatatttttcctcctgttcaagctcgtcttgataaagcatctgatttaaaagttgttttttgatgcgcttttttagtcggtcgtatttttctccttttagccaccagtgttttctttgtgcttgctgttgaactatttccttgttaagtatttttcgccgctcggctattttttgcttttcaagatttatctcagcgatctgctgctgaatgactgtaactttacgtaacgagtaaaatatatcctggcgaaatacaacttcgccgagtaactccttcatatctaacagtgactgcaggtttttaagttgcatatcatacaggcgttccttttcggctaacttttctttttctgcatttaacttttgtaatgatgcttcacatgcagccaggctctgcgctgttcttctgataagtcgattaactttacttaacaattcgttcaagctcttttagcgtttcactcattggcattttttcattaactgactgtttcaaccaatttgtgagtttaggccgggcattcatagcaaaatcattttcagcattttgccctgcgcgatattcccctaagtcaataaacacctgtagatcttccaaagttgtgaggttcttccttacccgtgcagcattatctctgtgtttttcatcagtgacctgaccaaatactcgactcacactttttagaacatctattgccggatagtgaccttgacccgcgagtttgcgacttagatagatatggccatcaaggattgagcgaatttcgtcacccagtgggtctgattcatcttccccttccagtaacacggtataaaactcggtaatacttccttttagtgttggtcccggcctctccagtaagcgaggcaaactgtcaaaaacagaagcaggataaccacgtctggcaggtggttcacccgctgccagtttcatatcacgtagtgctcgtgcataccgcgtcattgagtcgataaaaagtacaactctctttcctcgatctcgaaaatactctgccacggttgtcgccatcagggcggcattacaccggtctactgacgaaaaatcagaggtggcatagaccaatacgcatttcgctgcatttactgattttttgagcgattccgcgcattccgtaacttccctaccacgttcgccaatcaagccaataacaaacacatcagcttcagtattgtttacgagcatatgcattaaaaccgttttgccacagccagccgaggcgaaaatcccaacacgttgaccaatgccacatgtcagtacgccatcaatgactcttatccgtgtctcaagtggtgtattaataactcgacgttcctgatacgacggtggcagttcatcaatcaggcgtaaatttcccctatcgcctggagtgtccgggacaaacctttccataatttgaccagaggcattcaaaaccgaaccaagaaaggcatcactgatctgtatggttaactgctctcccgttggtttcaaaactgcagtacgtgtaagccccacagagctgcctataaggtttaataatgtcttcccattgcgaaagccaacgacctgagccctggctatacgttcatttgcttgcctgctcgcataaatttcgcatacttcacccacagaaacgtcgtcaagttctgcttcaatcagagagccgtttatgctatgtaagtagctgtatttatttaataattttaattttttcataccagcatgctccatatcgcaagacattatcctaaatagttttcagaatattaacgggaacattttccgttagttccccgtacgaaagtacttcgaggtctcgataactagattcaataagttttttgataaaacgacgaatatccacagatcccagtaaaataatgtctttaataggaatattgattccagaaagtgccagtttaaaattatccagaatcatctcagcttcggatgcatcgagattaagaaaagtaccgccagcggtaggcctgacaccatctctgattctgtcctctatttcaggcgaaatcacaattgctttaatttctccagaatatgaaaacttatggcaaatgtagcgacctaatgcacctcgtacatgctcgacgagtgtgattatatctttctctcgtgggctccataatgctaaggcctccataactaaccgcatattgcgcactgaaattcgctcctggatcagacgctgaattacctctgaaatgcgctgcacggttatatatcttaatatttcttttaatagatcagaatacttcatctctaattgatcaagaatatattttgtttcttgtataccaaagtactcattaatattatgagccagacagacagataaatgattatacatttcatccatggccgtgcgagtataacagccaatttttgttaatttttgagcatcacttttcgtaacccaataatattgttcaccattactatttacaatgacaggtttcttgatcaaagtcgaaaccacttcatctgaatattcaaccaacaagacaagatcatgataaattttaaattgtgaagctctgacttcatttagcattaatatgacatcttcatcattaagaccttccccctcacgaatgacaataccgggaatgcggataccatactcaataaaaaactgactacgaatcctatcagcaagattgatttcagtgtattttttagcctgtacactattcataatcaagaccaagggtaccgtttcggtaataacctgatcaagtttattaatgatacctaatgagatatcatcatcttgattatagggttccaacccaacggtaatatctccctcaacaaccgtttcttcagtccctttctttttgaatttaaagtaaaagtaaattcctaagattactgccaaacataaaaacactagaaggggaaaacctggaagcaacccaatacttagcgcgaggacacatgtcacaacaatgacaaaagaattacttaataactgggacattatattttgccccatattatcactatcgccatttacgcgcgtaacgataaatcctgcgctaatagcaattaataaagctggaatttgagaaacaagaccatcaccgacagtaagaattgtgtagacagtcaacgctgttgagaaatccattccattttggcctactcctactgatagcccaccgataatattaacaaagataataataatgtttgcaatagcatcacctttgataaatttcatcgcaccatcaaaggaaccatacaactggctctctcgttctaatacactacgacgttcttttgctaaatctgcatcaatgatcccggcgcgtagatcggcgtcaatgctcatttgtttacctggcataccgtcaagcgaaaagcgggcagcaacttcagccacacgttccgaacctttagtaatcacgataaactgaacaatagtaacaatggagaaaataacaaaaccaactaccaggctatctccaataacgaactcaccaaaactcgttataatttctccagcatccgcctcaagaagtataagtcgactggtactgatcgccagcgccaaacgaaataacgttgtgataaggaggattgatggaaatgaagaaaagcttaagatcctatcaacatagaatgatcctaaaaatacaagtattgccaatgttaagttaagcccaatcaaaaagtcgattaaataggtgggcaatggaattatgagcatggcgataatcatcaccattaatccaagaattattaattctggatgactccttaaccctaccaaaactttgttaaacattgaacatcaccttcttccatggttttttattttgttttttgttacagttttgtgtatcaaagagctctgctgcaaatgttacttttattgcctgtttacaacactccctaatctctaataattgttcattattaataaaaagtgaaaatggaagatttgtacatccactgtaaatcgccttcaggagtaacgttttgtctttataattagcatctgcgggaagggtcaccagtgcattgttcaggagttcctctgcagtctcaggaaattttattaacgatatcagaaaaaatatccagtaatcttctgcgctgataaattttttaattattgggttattcattaaagttttcagaaataaagcctctgccgactgaagagacaatagttgtgacaacttattgagaaacataccaaattccaatgatgaacaactcgcatcaagtgcatttatatctgagaaaagcgtctctttgataaattttgtcaccaacattctattttgatagccataactaccaatccattcgacataagtatctacagcatcgtcttctgccattaaaaattgccgataactcgcccttagtaattttggatttaatgacagcgcctggccaaataactttgcttttaatgccgagttaattccgctattaatgaattttttagtagtctcttgattaacttttctaagtaatgcttcagcgtttagccggacattttctgatatttgttttttacgtaaaattgcacgtaacacaactaccagatcgctttcatctgggaataattttttagcaaagctatacacttcatagtcatgggtagttgcagccttaagcgcctccataactttgtcggttttttctattggctggtcttccaggacatattcttctccgtccagaaaattggccagttgttcttcgtaaatttttttcttcataaactgcgttaacgctgctgacatctcgtcagtagcttgtaagaaccgagcttctttacctgcgggatcatccctcattttaggcatttcagcttcaatgtcttcattatcttctgtgataatgtcctctaagcgagaaacttccctggctctttctaatacaccgacatgctctacatgaatcgccatttcactatcctccgacgacttcacgattcaggtaagtttttatccatttctgcagtaattcatcgttgatttctttattttttgccatttgctgtgtaatcgctctggcatcaaccgcagcctcattcgcattattcatcatgcgttcatcgatctctcttggctcaataagaaagacacgaacgatgttattcgcatttgttccttcataaccaaataatttaccaataaatggaatgctgcctaatattgggatcttgcgactttcataggtattcgtatcgcgtgtatatcccccaatcaaaagacttttcccttggggcacgcgtgcaatagtacttataagtgtcctaccaacctgaggcagatcatcaacattggtcttgtcggaattgatttcatttccatcttcaatattcaagagtaattcaatttgatttcgcgcagcaaatcgtggtagcacgctaatcatcgtaccataggttacttcatccaattccgcagtacgctcgccgactaatttagtatagaaagtgcggttattatcaaatatagcaggaatattctcttgtgttaaaacgacgggacgagcaacaacggcggctcttcttttttgtgcaagtgcctgtattgttgcaataaactgtgtcccatcaagggtactaattgaacctgaattattaaatgatgcacttaagctggatccaatttttatcgtgcccgaccagtcagcacctagctgttctagatcagtcttatcaatatctattatccataaagataattcaatgtgtcgctttggaatatcaagcgtagctactaacttctcgataaaatcaacctgagatactgttcctttaacaagtaaactgttggtatcaggatatgcaataatttgtatatcgtcagtctctggcgctcctgctgtcgatattattttctctacttgtaggtcatcatcttcttcagccccaggaaaaggaggcatacgtgatacgttttttagttgttgacgacttgaaatttcagaaagtacgttcacccctgtgctttgcttaatgttattatttaacaacgtcgatagtacttttgccatgccaggaataactatcttttcgccacgtaactcataagtccggtcattaacgaatgtgttgaccagatgaattattcctactttatttcgaccgatctcaatgccatcgctgttttgctccattaatttcgcagcattaacgaccaggtcaacataaaccggtggccccgatacatagaaagtaccattgccgtcccctttaatttcataacgagagttatacagacccgatttttttaagaaattattaaactcattcgtcgatacctttctcagattaatcaatgcattacgcatctctgatgagtcatagatataaatagctttgccatcatcataccaaataagccccatctgtgccgacaggcgttcaatcaaggcatagggttctgttaaatcaaaatttccgctgatctgtttcttcatggcaagcttactaactattgtaggcttacccgcatatgatgaaaccgtttcaaaaaaactacgtagattttctttatttgctacgtatccattcgctgctgcggcatatgcaccaggagtcaataatccattaaaaatgcataagactgaaattaatataatagtaatgcgtaattttattttcataactttttacatagttctctcggtgtttttcctaaccggctttttacttcggctgaaaagtgtgatgaggacgagtaaccatatttatgcgcaatagttgtcatatcactgtttccttcaatgatttccaacacggctctggcaactctccagccacataattccgttttaactttaccacccaatgcataactacataaacggcgaaaatgtgaatacgatacgccgtaaagctcaccaagatcatagagtgaagtatgtatgagcgattgcgataataaataacgaaccagtttatagcattctgtttttcttagatgctgaaacaggatttcattaatattatcgctgctcagataagtggctaaaaaccaggcttcacttgcaactttactgaatagcacaacttctgatgcaaagggcaaggcatcagcaaacaattcatggtgttccctttccacactccccgttgattcatctataaaagctaataatttactcaggatatcaatgcgaagtggatgataaattactttccctgcagttacctcaatttggcttcggtcaatgagcagtaatatatcttccactaccattaatttttgatggttattaccaatcgtaataacaagggttacatccttgttttcatttccccgtaagaaccacatttcagggtccagtagggttaacttctgtccttgaagcaaaacattcattggaagtaacagcccttcttcaatcatgtttcatctccttattccatattctcattctccataaacttgctataaaaacatgattaaaaagtgatgattactatttataaaataatgattttgttatgagcgaatagctatcagccacttacactagtacgtcatcctgtccatatacagatttgtaactgttgatatgttttacttaaacacacctcgtattacttataacacttgtttggtaactattttcaatacaaatcatatttgttagttcttcattaacacactgcgagtgttttgttactccccgcatatattttattctcttgttcgattctatttttcttaatcgatcatataattttcttgttagtcggatttacgaatcatgagacttataatggaaggaatgagactaagcggccaggttaaacctgtaattattgcagcaaacaaccgatatgttactttttcttccgagaagataaatattaaagtcgatgtcacaaccagacctatcaggtaagctaacagtaatttattgatcacttttacctcccctttcgatttctctttgagcggtccttttaatccaggaccgcctcattatgaaaattatttaattccctcatcattgataaggttggacatctctttcaacatgagagtcattgaagctttcgaccaatttagcggaatgatagggcttggcgcttcatgcaaagttcccgacttgtggatatagttatagctttcgggaagtgccatttctggtacgctcctgccatttgcaccaatcatattctcgcctgttatttgggccaatgatctattcataaattgtactgagtcattcaaatactcttcttttcttgattctttataaacaattgctgctgattttgcataccatgagtcaaaaaaccattctgcttctgttgatggaatgaagctcttttctctttttgcatgcgaattttgatcggtatcggttttaatatcattgaaccaaaaatttgccgactgataattatccttctcgtatctttttataccatacggacctgctagttttttaactatttttaga

SEQ ID NO: 167 - DNA  (genomic), 78 bp; double-stranded, linear
gagattgcgaaaagtctgaagcgattgaattaagataatatagaaaatcagatacagcaaaaatggcagattgatgag

SEQ ID NO: 168 - DNA  (genomic), 80 bp; double-stranded, linear
ctcatcaggcctggcactcttttaatatattgagctcgcaatattttatattacgcctcagccgaaacacacaaagcgca

SEQ ID NO: 169 - DNA  (genomic), 395 bp; double-stranded, linear
actcctcccctgagactgactgttaataagctggcaaacttatcagtaacagtacaatcagtatgatgacaagtcgcatcataacccttctccttcaagccctcgcttcggtgagggctttaccgttacagccccatgctgccctgccatcgtaaactctctttaaataaccacaacgcattgatctacctttaaatcttttcttcgagcgcactcgtaaaacgtcatgtaaggcagacatacattgcaggaataagggattaattacggcagtaaacgtgggcgatgaagtggctatcaaaaagttcggttcagggcgatgcaccccgcatcgccctgattgacatcgttgattctttgacctaatttagtgagtaagggtaagggaggatgac

SEQ ID NO: 170 - DNA  (genomic), 3267 bp; double-stranded, linear
cccctgtggaatttattccactttgcagaatcacgaataagcgtagcaaaatcttttcgttgtgccgtcacaaaccctgacttatatcagaatatgactgatgcagcgtcgatattatccgtaatacgtccgagtttcggagtactccaatgatgacattgccctacccatattcttcctccgcacgcttttacgcactgcgcctcctccccgggcaggaagttttttcccagctacacgcttttgcacagcagcagcaacttcatgccgcctggattgcaggctgtaccggtagcctgactgacatcgccttgcgctatgccgggcaagaaggcaccacgctcctgaacggtacattcgaagtgatctcactaaacggcacgttggaacagagtggtgagcatcttcatctctgcgtttccgatccacacggcacgatgcttggcggtcatatgatgcccggctgtaccgtgcggaccacgcttgaactggtgatcggtagccttgaggaactggcgtttagccgccaaccttgcgcgctttctggttacgacgagttgcatatttcccccgttaaataactactttcagagaggttttcttatggcgcgtagccacttttccagtcaggcactggtgttgatcgttatatctatcgccatcaatatgatcggcgggcaactggccagcatggtcaaattacctatatttctcgactccatcggcacacttattagcgcggtactgcttggtccggtgatcgggatgctgaccggcttactgaccaatttactctggggattactgaccgacccgatcgctgccgcttttgcccccgtcgcgatggtcatcggcctggtcgccggttggctggcgcgagcgggttggtttcgcaccctgccaaaagtcgttgtcagcggcgtgattattacgcttgcggtaacggtcgtcgctgtaccgctgcgtactgcgctgttcggcggtgtcaccggtagcggagccgatttgttcgttgcctggatgcactcgatggggcaaaacctggtggagtcggtggcgattacggtgataggcgcgaacctggtcgataaaactcttacagcggtgattgtctggcttttactgcgccagctgccgattcgcaccacgcgccattttccggcaatggctgccgtgcgctaaatgcatccatttacctcattaacactatgggcattggcggcctgcaccacgcttatcctgcccgcgcagaccattttgccgatctatagcgcggcgacctttttttgccttattgcgctaaaggccacgcggcggcgggcaaaatatgtcgtctggctgatgttctcgctgggagccgggctgtggctggtacacggtggctggctaacagaatggctaagcggcacgccgcgttcgccggagcgttggacgcatgctattacgctctggttgcggattctggcgattgtttcaacctcacagttgtggatgcagtacgtccccgtgcaatgttttatccgcgctctgtttgcttctcgcctgccgccgggcgtcgcttatctgtttgccgggccgttattggtcgttgagcagttaaaacggcaattagcgattattcatgaagcgcagcgtgcccgcggcgtgccgctggatgagggctggtatcagcgtttacgtgcgatgcccgcgttaactattccgctaacacacaatgcgctaaacgatcttgctgtccgtggtgcggcgctggatatgcgggcatttcggatccacaaccgacgaacaacgttgtgggcaccagccgatagcaccctacaacgcgtagcgcgttacaccatgatcttgctgatgctgacagaattcggagcgtggatatggttacgttagaacagttccgttattgcccgacacactcaacgcatcctccgttctgttatgactttcactatgtcaaaccggggatggtcgccatctttggtgacaacggcagtggcaaaagtacgctggcacagctgatggcgggctggtatccggactttctgccaggagagataacaggcacggggacgctcctcggtacgcccattgggcatctcccgcttaatgaacaatccgccaccatccagctcgtccagcaatcgccctatttgcagctctccggctgtacctttagcgtggaagaagaagttgcctttgggccagaaaatctgtgtcttgctgaagcagagattatggcgcggattgatgccgccctgactctgaccgagtgccagccgttgcgccatcgtcacccggcaacactctccggtggagagacacagcgcgtggtcatcgcctgcgccatcgcgatgcagccaaagctattaattcttgatgaagcctttagccgcctgacgccgcaggccagcgaaatgctgttgcagcgcttacaacactgggcgtttgaacgtggttcgctgattattctttttgaacgtcatcgcacacctttcctgaactactgccagcaagcgtggcaattgcaaaacggagcgctccagccactatgttaacgttaaatcagatatcttatcgctggcctggcgcggcaacggattgtctttgcgacatttctctgcaactcaaacaaggtgaatggttggcgttgaccggcgacaatggcgcagggaaatcgacgctgttacgagtaatggcaggtcttcttacgcccacagccggtacggttatgctgcaacaacaggcgatgaaaaacctgaaaaaccgccagcgcgcggcaaagattggcgtactgtttcaggaagcggaaaaccaactttttcacagcaccgtcgctgacgagatcgcatttggtttgaaactgcaaaaatgcccggcggatgaaatcactcaacgtacccatgctgccctgcaatgttgtcagttagcagacactgccagcgcgcacccgttggatctgcatagtgcgcagcgacggatggtcgccgtcgcctgcctggaagcactctctccgccactattgctgctggacgagccgagtcgggattttgacgaaaattggttgagcgtgtttgaaagctggctggagaagtgccgccagcgaggcacgagcgtcgtagcaatcagtcatgacgccgcatttacccggcgtcatttctctcgtgtggtgcgactggaagatggtctaatcaggaacattaatccaccagacgatattcacccgtagcggtcatcattaaggtcaaatttgcaggcagactctcttcc

SEQ ID NO: 171 - DNA  (genomic), 935 bp; double-stranded, linear
gaaacacaagtttgtgctaattatcgccttaaatgggcgaggcatcaagcgaggttgctatttccgacacggtggcggcgcatagccattgttatctgccggaaaggcttgtccagagcacggtggcagcgcgttttgcgcctggccttgtaattcaaaggcggcaaagccgattacaccggtattacgcacatcgccttgcgccgaattggctgcgtaggaatcagcaacgttggcgaactgaaaagccgcttcggtatgtttatctttgcggaatcctttaatcgctaacgaatctccggcattcacaatatagccgttgttattcagcgaaccttgcttgccgttcagcacatccaggccatcaaccgtagcaacgatctcgtagttggtgttacgactgtaattacggacatataattgataattcattccgactctggcatggacaatatagcgtggttcattattagatgaatcataaacacgcgtaataggtagagaattaaaattaccatcgcgaatagcatattccagttcgttaatacgaatgctataaacgcgatcgtagccggaaggaacattagtcgaataactaataacgatcatctccgccggatcgcgccaggctcgctcagcagatacgccctgaaccgttgagtgcacatccccaccccaggcggtgccgacattgcccgatgcactgctattatactgcgcattactggaacaaccggccagcagcacgattaatgccaccaacgcgctgcgtactttccattttttcataaccgttccctctgcatttaattaatgcagcgattgtagggagattatttaataagaaaagcagctaaattatttttaagaatatataaaaagaaagcggaccgatttacgtaaataaatcgacccgccagcagaataatcttaat

SEQ ID NO: 172 - DNA  (genomic), 87 bp; double-stranded, linear
gtgagcacctcagccgacatgtggcagctgttgtaggtctgataagacgcgctagcgtcgcatcagacgttgattgccggatgcggg

SEQ ID NO: 173 - DNA  (genomic), 23451 bp; double-stranded, linear
attcatatcaacggacctccacggaggtccgtttttcgtttcagaacaccatgatttaagtgttcttcctccaaatcaattctaccgaactcaaccaaattctccccacatcaacctcattgtgtgggtataattgcgggcataccccagttcgacagaatttgtaccctctttaacgcattcagaaggctgaactatggcactgactgacgcaaaaatccgggctgcaaagcccactgacaaggcttataaactcactgacggggctggcatgttcctgctggtacatcctaatggttcccgttactggcgtctccgttatcgtattctgggtaaagagaagactctggcacttgttgtgtatccagaagtatctctctccgaagctcgtacaaaacgggatgaggcccgaaaactgatttcggagggggttgacccttgcgaacagaaaagagctaaaaaagtagtccctgatttacaactctctttcgaacatattgcacgacgctggcatgccagtaataaacaatgggcacaatcacacagcgataaagtactcaaaagcctcgagacacacgtattcccctttatcggcaatcgggatatcacaacactcaataccccggacctgcttatccctgttcgtgctgcagaagctaaacaaatttatgaaatcgccagtcgtctgcagcaaagaatatctgccgtaatgcgttatgccgtacagtctggcatcatcagatataatcctgctctggatatggctggcgcattgactacggtaaaacgccagcatcgccccgctcttgatctttctcgcctgcctgaacttttgtcgcgtattggcagttacaaggggcaacctgtcacccagcttgccgttatgctgaatttactggtttttattcgttccagtgaactcagatacgcccgctggtctgaaattgatattgacaatgccatgtggactattccagccgaacgcgaacctctgccaggcgtaaaattctcacaccggggatccaagatgcgaacaccacatcttgtgccactcagcaaacaggttgtagccatactggcagaacttcagacatgggctggtgaaaatggtctgatctttacgggagcacatgacccacgtaaaccaatcagtgaaaacaccgtaaataaagccctgagggttatggggtatgacacaacccaggatgtctgtggtcatggattccgggcgatggcatgtagtgcgttaatagaatcaggtttgtggtcccgcgatgcagttgaacgtcagatgagccatcaggaacgtaacggtgtacgtgctgcttacattcataaagcagaacatctggaagaacggcgactgatgctacagtggtgggccgattttctggatgcaaacagagaaagatttatcagtccatttgaatatgcaaagattaataatccattaaaacagtaatcatcccgggcaaatgcccgggaacctactccaggattattttctttgttaaaaaaacagacaaaacggtattagcttcgtaagcgtacagcgagggccgtattgacggggatgtgttattcagctggcagtgctatgcgccacggaagcagttcgctgacccggttgaccggccagtctgctatgacgccaagcacatggcgaaggtagctttctggatccacgtcattcagtttgcacatcccgatcaggctgtacagtagcgctccccgctcaccaccatggtcagagccgaagaacaggaagtttttacgacccagactgaccgcccgcagggcattttcagcgatgttgttgtcgatttccacccagccatcgttcgcatagtacgtcagtgccggccactggttaagtgcgtacgcgaacgccttcgccaactctaagtgtcgcgacagggtcttcatcttttcacgcaaccagctttccagggatttcaacagcggtttcgtttttcgctgacgttcagcaagccgctgctctgccggcattccccttatatccgcctctatggcgtacaactgaccgatctgctccagggcttcttccgtcagtgctgacgggatgcggacgtgcacatcgtggatctttcggcgggcatgagcccagcaggcagcttccgttatcccaccattgcgatacagctcgttgaacccggcgtacgcatccgcttgcagcacactgtcacgaacggtgcaatagtcatccgtcgttgacaacagctgatactgagggtttccgggtcctctgcgagcgattctggctgttcggcagctgcatcgagagtcacaggaagtagctgggggctctctgaagaaggtaatagcagctttccctcgcgccattgttgtgtaagcgccccatctgcgacgtcttgtgaaaattgtcctgtctggcaacaatcgcgcccatctatatagatggacacgaacgatgaattcccagacaaaaaaagatattccctgcttccgttcttatttgcctgatgctctgcgtttaagatttgaagataaactgaccatccgggccatcgctcagcgtctaggtctcagtcattccacaatacatacgctttttcagcgatttattgcatccggtatcgcatggccattgcccgattcagtttcattagctcagcttgacgccatcctttatgccaacagaaagaaggaattaacagagcctcaaatcagcgaaggcacatggcgaaaagaacgacgaacctcctacagtcgtgaatttaaaatcaggctggtaaaacaggcattacagcccggtgctgttgttgcccggatcgccagagagcacggtatcaatgataacctgctgttaaaatggaaaagccagtacgaggacggcttactgagcgatgatgacatacaggaatgcatgcctgtcccggtggctctgactgatacgccagagccgaccagaccagttacaaatcccttctggcgtaacaagcctgatgagtgccctgagagtgatcccggaaacgtcccacggtgcgagctgcatcttaaatcaggtgtggtaaaactgtttgaccctctcactccggaaatgttacgggcgctaatccgcgaaatgaaaggaggtacccgatgataacgctgccaaccggtaccagaatctggatcatcgctggcatcacagatatgcgttgtggcttcaacggcctggcttcgaaggtgcagaacacgctgaaagatgccccgttctccgggcatatcttcgtcttccggggccgcagtggcaaaatggtgaaaatactgtgggccgatcgtgacgggttatgcctgttcgccaaacgcctggaacggggccgcttcgtctggccggtaacccgggaagggaaagtgcacctgacgccagctcagttatccatgctactggaggggatcgcatggcaacatcccaaacggacagaacggcctggcatccggatataacccgtgataaaacaggggaatgaacaacacactccccgacaacatcgagcaactgaaggccctgctgatcgcacagcaggctgttatcgtccgtctgtctggtgaaataaccggctatgcccgcgagatcagctcactcagagcgctggtcgctaaactgcagagaatgttgttcggtcgcagcagcgagaaaagccgcgagaagatagaaaagaagatcgcacgggcagaaacgcgtataaccgagctccagaacaggcttggtgaggcgcagttgcaactcacctcaatggccggagagacagcgccgaaaacatcagactctcccgtccgcaaagcacttccggcaacacttccccgtgacaggcaggttatctccccggcagaaaccgaatgccccgtctgcagcggtaaactgaaaccgctgggagaaagcatctctgaacaactggatatcatcaacaccgcgttcagggtaatcgaaacggttcgcccaaaacgggcctgcagccggtgcgactgtatagttcaggctccgcagccaccaaaacccatcgagcgcagttacgccagtccggctctgctggcccgcataatcatggctaagttcgccgagcatctgccgctgtaccgtcagtcggaaatctatgcccgccagggcgtggagctgcaccgcaatacgatggggcgctgggttgacatcatgggagagcagcttcgcccgctgtatgatgaactgaagcactatgtgctgatgccgggtaaagtgcatgccgatgacacgccggtaaatgtactggagccgggtcagggtaaaacccgtaccggacggctgtgggtctatgttcgtgacgatcgcaacgccggttcgaccatgccggcagcggtgtggttctcatactctcccgaccgcaaaggcatccacccacagcaacatctggcggactacagaggtatcctgcaggccgatgcatatgcgggttacaatgctctttacgaaagcggtcaggcaaccgaagcggcttgtatggcacatgcccgacgcaagatccacgatgtacatgtccgccatccaacgacagtaacgggagaagcgctccgtcgtatcggggaactgtacgctatcgaggctgagatccgcggcagtccggcagaagagcgactggcggtcagaaaagccagaacggtaccgctaatgcagtcgttgtatgagtggctccaggggcagatgaacacgctgtcgcgccactcggatacagcgaaagcgttcacctatctgctgaagcaatgggacgctctgaacgaatactgccgcaatggctgggtggagatcgacaataacctgtgtgaaaacgccctccgggtagttgcactggggcggcgtaactaccggacgtggtttctgccaggtaaaggcaacggaacaaaagaatcatggtttttccggaaccggccacaccatgaatgacacgatgcccgtcaccaatatttctggccagaatctcctgctgaatatccataattttgatttgtgagttctgtttcacggtcacttcaggaaacagatgggcgcgcagaatatccctcatccggggtgttacccgggttctgaaccccgtggtaaacatcccggcaattttttgccggaatacctcaggtaaaacagactgcgtcatttcatcctgacagattgtctgtgctgaaggaaaaatcttttccaccgcattctcattattccctgtcagtgccttcagttgctgacgggtaatgcgggtaaacaccacaccatacgcccaggccaggttcagccgccccttatactgaccgtcattctgccgtaagcacgggtcagcaggtaaggcattaaccgtatcacaggcataacgacgaacctgtaccagcggatttatttctgatttcagaagaccgtcggtttccagtgtaacctgctcctgatttgctttacgtaatgtggatacagtccagtccttgacctccagaaataccagcccgttatccgggtcaataatgacaaaatccggatgtcggtttttccgtcccaccgggatatcgtaccagacaaagcaatcatcattcagaaagctctccagtcgtgaagccaccctcctctcccctggcgtcattctctcctcagtggacgctgatatatttatcagtttcgccataacatactcatgctccagtaaaaccataaccgtcgacatattccgtctgaagggaatatgtcgaatacttcattaaaatacaaacatttagtaaacttcactacgcaagtgcaattatccagtcccgtctaatgattaaaaacgataaccaactccaacagtaaatccattgaccgaatgttttccatatatatctgctttagttccctcatacccaacatttacagacatattgccccacggattaataataacaccagctgcataagcaaaatcagtggatttttttgatacagactcacttaaatatccatcagactcatcagcacccacactgtttctccactcataatctcccttcgctttagtatgagatatccccaccaaaccataaaaactgatatagtcattcagacgataagctgggcctgcgagaaatgaataatatttaatatcagcctgatgtctgtaaaaatcgtcagcttcatcgcgatgactgtccgcccaatcacctttcatatacgaaaaactcccgacgacactgaccggagaatcccactcatatcgatattgcagattcactcctttaatattcttaaagtcctgtaccttactctgagcataaccagccgatagcgtatgattatcagccagtcttgaaccactcataacatataatatcattactgaaattataacgagtttttttcatttaaccctccttcattaataaatgatttctgaaaatcaaaaaggaccacacatctcaaaaacattatttgaaatcatcatcaaaaaactataaatatatcacctgacgatttgaacacactgacaaaaaaccaagcatggtaataaaccgaactccccacaaacttctgttgcctcagatactcccccccctttcctcaggcacaaatgttgttccataacgaaccagccctgttcctttaaactctgcatcaatggcataatgtatactcaccagactgagtttgctcctgcatcattatttcgatacgttaatgcattgttcattgcatccggcattccccatcgaatatttactttgttatatcagtcagcccataaccaggtaaatttttaaggcttactgactgaatattcaaaatgtgttacatgttatcaaacctttaaagaataacctgctcttcttcattggccggatttagctcaatcttgtcagcaaaactaatataaagccgttcataaagagaaggatgtagcttcgttatttatcttttacatgtaacagtgccaggggatattccgcacatctctgtggctatcatccccaccacgtctccagtggcagcacctgcggcactggcacgggcgttatttccctgtaccaccgccagtgcagcattcaccacggcatgagctgccacatttgcagtcttattcaccacacctgtaacctgtctcttatacacaaatccccacccggggatttgtgatgtctgtcagtctgctttagggggactctttccatccggtagtttccttcctccccggcagcgattttttgaactttttcttcacccgttgatcttctcttatatttcattttcttcgggtctgttatggtactttctgattgttattcactggctaacgagcagtctggacatgcccgtctcggtgatccgcgtcgtacacgacgccttgtgtcactgacctcttctctcgctcagcatgcaggtctttctattgtgaaatcatcccacttcactgctcaggttgaaggtgcgtaccgcctgatacgtaacccgtcggtgtccccgtaagccattgccgaagccggatttactgccactgcaagggcatgtgaggcacatccgctgctcctcgcgctggaagataccaccaccattaacttcggtcacagtacggcatttgatgacctggggaataccaccactaacccgaagacgcacgggctgctggctcactctgtcctgatgtacgcccccgacagcgccctgccagtcgatcttatcgaacagcagtgctggagtcgtgccacggacacctacggtgttaagcaccagcgaaaagaacgtccctgtgaagaaaaagaaagttaccgctggcagcaggcttcggagcgcatggccgaacggctgagggagatacagaaacaggtaatcactgtctgtgaccgggaagcggatatctggcattacctgcattataaagtcagccgcgggaagccacacgctgaatgtgatgcaaaaaggcgggcgggcagcccgccaggcccggatgctcatcagttacagcgaagtcagcataaaaaatcccgacaacagcggccaggcgctctcgctcacgtatgtctgttgcggggagcaggagaggacggagcctgctggtatccgctgacatcagaaaaagtggcgagtgccgccgatgcgcgacgtatcgtcagccattacgagcaacgctggctgatagaggaataccacaaagcgtggaaaagtggtggtacatgtgtggaatcgctgcgaatgcagacccgggataaccttgagcgcatggtggttatcgcggtgcgggtgctgggcctgcggcagggaggtatcagtgaagaaacacaaaatgacagctgtgagaaaatactgacgccgacagagtggaaactactgtgggttaagctggaaggaaagcagcttccggcgcaaacaccgaccctgaaatgggcctgtttgaaactggctaaactggggcgatggcatgacagcaaacgcacaagcagccccggttgggtagttatgtgggatggctggttcagacatcaggatatggctgagggttacctggtgatgaagtctcttgatcaggagatctgatcaagagacaggtcaaagatgggggacaacgtctggtgctgtataacagcacaggcctcacactcttgacgcccgtggaatatattagagaacaaaaatttcaatatgtggtggacgcatacagaggattgacagcattcccatactaattgttaagattcaaattgaagtatatctatctgtcattttgcaaatgatatgcggtagctttacctaactatcatgaacatttcgaaaaatcatccacaaagccccgaagaataaagcactatcgcccgataaagacctgtaagctcagtggcatggatactattgagctcagaatggcgagctgtaccgttatttcattaccatgctcgacgaacacagcaactactctctggccgtactatcgcttaaaagtgatatcatcaggcatttcttctgctgtgtagcccagttgttccttgttggtatcaaccagatcatcactgatgatgggcaaagagttctcgggaaaattcgacaaaacgctacaggaagccaccgtcgggttcgtatggacttatctctatacgccgaaaataaatgccataagtgagcattttaaccgaacactgagggaacaatttattgagtttaatgaagaattgctctttgaatagctgaatatgttcaatctgaaactggctgagtatctggtactgtacaacagtaaaattcttcataaatcgtttaaactacaaaaatcagtagaatatattatttccactgtcaggcggaaaatttatagaaaggatacaaacatatgccaataataaacaaatcggcatcaaattatgttgaatatatttcaaaaaacaatcccccttatttatcaaaaaagagagatgccagtataaatctaaatggaaaggttagtgattgcaatggggaaatcatatggtgtcgacatatagcatcatattggagtgagtttttttgtagtaattcaggaaagatagactacgaaacattttcatcccctcaattattaagcaaagctattgtaattcaggaaaacaaggggacaaataatattaagggtgatgtgtattttgttgaaaatgaatcttggggaagcgttatatataacctttttcttcaacttgagaaagagaataaatctcacacatcattagaagttcattctcccggacatgcaatggctctgggcattaaaataaaaaacgacaaggaaaataagtttgttattaatttctatgatcccaatcagaccgcgacgcataaacgagtatttttttgcactaataacatttgtgatataataaacctgacagcatatgattttcttagtgagcaatgtctgaaatgttatgggctaaaagaagacacactgtcactttttgtggataaaacaaaatcgaatgacaacaataatgtgtttataaaaaaattacctgataatattctccaaggtgttgttattaattttgctatgggagcaggactaagagagataataaaaaaggtatataacgatactcgatttacagatcttacaaaatctcagatgaaaatcttgtgtgaatcaaaaaatgttaataatgttcctgggttgcttttagctctacaaaatggacatgataatgtaattgatgaatatggtactttaattaaaaagtcaaatcttaataaagaagaattaatacatatattatctgcaagaactttggatggaaccatacctggtttatatcaggcccttcaaaatggacatgctcaagctattaagagttatggtaacttagttctggatactattaataaaaatatagatttagagtatttgctttcagcatttaaatatgaggcacatagctctaataaatatactcctggattattttctgcatttcaaaatggtcatgcagacgcaataaaggcatattgtggcgtacttggcaatagtaatttgaaaagaggtgagataatcaggatgcttgaggcgagaaattatgatggtgcaccaggattacttcttgcgtatcaaaatggagatattaatacgattcagtctttttttgactcactaataatgttagatatatcaaaggattttatcgaagagttattgactgcaaaacattatgattttacggggttatcattagcgatcagtcatagacatgatcatgttgtcaaattatacggaaagttatttaaaaaacttgataccagtccatataaaatgtcaattatcctagcattagcaattgattgcgagagaaataatgcaaacataattattgatagtgagtacaagtcaaataaggcagtaaaggaatatgtagaaattttaaaagaattcaatatatgcccagaaaaggtagcagaatacctaagcgagttcagcggaaaacatttcctcgatgtatataattattattccaattgaaaaaaatataaagtatctatcacggcactctcagttgagtatcacaggcacatgtattttagccccctgagtctacagacaaccaatattacttaaataagtgataatcttaatgctgttttttagaacagatgattgatatttttgggccggagaaacgcagacaggctttgttgaataaatcgagcttttgctgagtttaaggatcagatcactcattttcctgcaaaagctcattgggcgaaacaatctgactcagagaacccggattaaacgtctggcccgcagaatcatctatttctcacgcactgtagtacgtaataaaaaagtcatcggtacttttatcaaaaaacatatattctattaattattgccatcacctttttcttattgacaacattactctgctgattgttaaaatctaacctgtattcagggttacgattctatacaatagaacagggaggggaaaggatgtcatcgttaatgagactttttgttaatgtcaacaatgctatgaatttattttagaaaaacaattaagctgacgtagtgttccgtctaaatgacggggcgatattaacatgattagaacaagaggaattttatgttatcttcattaaatgtccttcaatccagcttcagaggaaagacagctttatcaaatagtacacttctccagaaagtttcttttgctggaaaagaatatcctctggaacctattgatgaaaaaacccctattctttttcagtggtttgaagcaaggccagagcgatacgaaaaaggagaagtaccaatattgaataccaaagaacatccgtatttgagcaatattataaatgctgcaaaaatagaaaatgagcgtataatcggtgtgctggtagatggaaattttacttatgaacaaaaaaaggaatttctcagtcttgaaaatgaatatcaaaatataaaaataatctaccgagcagatgtggatttcagcatgtatgataaaaaactatctgatatttaccttgaaaatatccataaacaagaatcataccctgccagtgagagggataattatctgttaggcttattaagagaagagttaaaaaatatcccagaaggtaaggactctttgattgagtcatatgcagaaaaaagagaacatacttggtttgattttttcaggaatttggccatgttgaaggctggaagtttgtttacagagacgggaaaaactggatgccataacatatcgccctgtagcggatgtatatatcttgatgccgacatgattattaccgataaattaggagtcctgtatgctcctgatggtatcgctgtgcatgtagattgtaatgatgagataaaaagtcttgaaaatggtgcgatagttgtcaatcgtagtaatcatccagcattacttgcaggcctcgatattatgaagagtaaagttgacgctcatccatattatgatggtctaggaaagggtatcaagcggcattttaactattcatcgttacacgattataatgctttttgtgattttattgaatttaagcatgaaaatattataccgaataccagtatgtatacctgcagttcatggtaagtcttccggttgtggttgaaaaatatcgttctttaggtatagattcagatgattaatcctgttactaatactcagggcgtgtcccctataaatactaaatatgctgaacatgtggtgaaaaatatttacccggaaattaaacatgattactttaatgaatcacccaatatatatgataagaagtatatatccggtataaccagaggagtagctgaactaaaacaggaagaatttgttaacgagaaagccagacggttttcttatatgaagactatgtattctgtatgtccagaagcgtttgaacctatttccagaaatgaagccagtacaccggaaggaagctggctaacagttatatccggaaaacgcccaatggggcagttttctgtagatagtttatacaatcctgatttacatgcattatgtgagcttccggacatttgttgtaagatcttccctaaagaaaataatgattttttatacatagttgttgtgtacagaaatgacagccctctaggagaacaacgggcaaatagatttatagaattatataatataaaaagagatatcatgcaggaattaaattatgagttaccagagttaaaggcagtaaaatctgaaatgattatcgcacgtgaaatgggagaaatctttagctacatgcctggggaaatagacagttatatgaaatacataaataataaactttctaaaattgagtagagaagctcagccacttgtgtaggggggctaaaattaattctatttcattatatgagaacaccaataagaataataatatttgatcacaactgaagatgctttttacaatgaagaattattgttaaaaaacgctttgttgaatcaaccgaactgttgctgagttgcaggatcacatcacgtattttcctgaaaacgcaggctgcttagtagcaaagcagaagttcaaaatcaccaactaaatagctgcgccgaatagtagatcaatgaaagggaactcagcccggattgtgcgatctgatcaatcgccaaaaatccccccctaaccggactgagcgatgccgatcatagcaccaattccccgcgacgaatgacgcctgatgcaaaaagcaatctataaaactcacgataaaaattatgcccgcaggctgaccgccatgctgatgctgcaccggagcgctcgcgtcagtgacgttgccagaacgctctgctgcgcccgttcctccgtcaggcgctggattaactggttcacgctgtcgagtgttgaaggtctgaaatcattacccgcaggacgttcccgccgctggccgtttgagcatatctgcacattgtttcgtgaactgataaaacactctcccggatattttggctatcagcgttcacgctggagtacagaactgctggcaataaaaatcaacgagataaccgagtgccagttacatgccggaaccgttcgccgctggttgccattagtcgggcttgtgtggcgcagggctgcgccaaccctgcgtacccgtaacccgcataaagcagcaattcacaaagcactggacgaatgtagtgcggagcatccggtcttttatgaagatgaagtgtatatctatcttaatcccaaaaccggtgcggactggcaacttcgcagacagcaaaaacatgtggtaacaccggggcagaatgaaaaatactatctggctggtgctttacatagtggaacgggcaaagtcagctatgtgggtggcaacagcaaaagctcagccttatttatcagtctgttgaaacatctgaaattgacataccgacgggataaacctatcacgctcatagtggacaactacatcatccataaaagtcgggaaacacagcgctggctgaaagaaaatccgaagttcagagtgatttatcagccagtttactcgccgtgggtgaatcatgttgagcggttatagcaggcgcttcacgatacgataacgcgcaatcatcagtgccgttcaatgtggtaactgcttaaaaatgttcattattttatggaaaccgtgagcccattccccggtggtaaatatgggctgttaaaagtgtagcggtattcggcgcagctatttaggatggtcaggtcgcagaagttctgtgccactacagtgcgtgtactaaacaaaatgacgagggcacgaatgtcataatacgtgcgtattacctgacagtagctaccaactgagggggcttattccaaacctgatttattcaacaaagctggacttatccttactctgaattattttccagacatatgcatcatgtactggctcgcttggttcaggaaatacaggagcaaatctacagctattagatttattcctatttgtatgcaaagtcgcattgcataatgcggagctatgttacagatacgcctgacgtgcgtagtaaaattataaagcaacatatatatacaaggagaaaccgagaaaaataaatgagtcgtatgttgggtagcatcgagataaatattttttttatcacattagcaccttggttaagggtgttaataataatattctctcacttattaaaacataaataattttttaagcggaaatgtaattatgagactgccagagaaagttctttttcctcctgtcactagtggcctgtcagggcaggaaaaacaaaaaaaaccgaagagcattaccggatttcaggaaaattatcaacgcaatatcaggccaatcaaaacagcatcagaagcccgactacgcttctttgataaaatggtttcgaaagaaaactctctggaagatgttgtttctttaggtgaaatgattcagaaggaaatttatgggcatgaacaaagaacattttcaccagttcatcatacaggtaactggaaatcatcattgttacacaacgcgctccttggtctggcaaatgtttataatggcttacgggaaacagaataccctaacactttcaacagagatggtataaaaagtactaactcttttagagataacttattgacaaaaacaagaactcccagagataattttgaggaaggaataaaacatcctgaacatgcaacaataccatatgacaacgacaatgaaagtaataaattgctaaaagcaggaaagatagctggtaacaataacgagctgttgatggaaataaaaaaggaatcccaaagcgaccatcaaatccccctgtcagataagttcctgaaaaggaaaaaacgatctcctgtagctgaagataaagttcaaaactcgttaacaccagaaaattttgttcagaaaatttcacttagtgatgagcttaaaacaaaatatgcaaatgaaattctagagataaaaagaataatgggagaatacaatcttttaccggataaaaacagtcgtaatggtctaaaacttctacagaagcaagctgatttactaaaaataatcatggaggatacctctgttacagaaaatacctttaaaaacatagagatggctatagcagatataaaaagggagtactattcgcatacagttgatattgagaaaaatattcatgccatatgggttgcgggttccccacctgaaagcatctcggactatattaagacttttctcaaaacctacaaagagtttacttactatctttgggttgatgaaaaagcatttggagccgcgaaatttaccagtgtcttaaaacaaattgcatttgatttagcatgcagaactatacagcagaatactccacaaaaaaatattgattttattaatctatataatgaaataaggaagaaatacaacaacaacccatcgggacaacaagagtacttaaacaaactcagagagctttatgctacttatcaaaaaatatccccccctctgaaacacatgtttaattcatttttttagaaaacatgattaaacttcaggataatttcttcaactattgcattgtcaaaggtgttacagagattaatgatgagttacgaataaactaccttaaaaatgtaataaaactgtcagacgatgacattggtaattatcagaaaacaattaacgacaataaagatagagtaaaaaaactaattcttgatttacagaaacaatttggtgaaaaccgcatttcaattaaagatgttaactctttaacctctctttcaaaatcagaaaataatcacaattatcaaactgaaatgttgcttcgatggaactatcctgccgcctcagacctgctcaggatgtatatccttaaagagcatggtggtatttatacagacacagatatgatgcctgcatactctaaacaagtaatttttaaaattatgatgcagacaaacggagataatcgtttcttggaagatttgaaactacgtcgtgcaatatctgatggtgtattaagatatgttaataaccaaaatattgatgaagttaactataatgaaatcagtgatgcagataaaaacattatcaagaagatattaacagaaatatctaaaatgccagaagatagtatttttactaagatcaatacaaggattcctcgagacacaatgcccatccttcgtcgttatcacctatggcctgatggatggaatattcgtgggctcaatggattcatgctatcacataaaggtagtgaagtgattgatgctgttatcgcaggccagaatcaggcttacagggaactaagaagaataagagataatattcatagtgaaatatacttcaaacaaactgattgaaccgccccggttttcctggagagtgttttatctgtgaactcaggctgccagatcatcgtttccgatggaagcataataagctttttctgcttctgccggaggagtatggcccagccttcccagcaatcgtcgattgttataccagtccacccacgttagtgtggccagttccacttctgcacggtttttccagctcttacggtgtattacctccgctttgtaaagaccattgatgctctcagccatcgcgttgtcatacgagtcgcctgtactccctgttgatgccagtaatccggcttcttttagtcgctccgtataggccagtgacacatactgagagcctttatcgctgtgatggatggtgccagacggacgacgggcccacaacgcctgctccagcgcatccagcacgaatgtcgtttccatagacgatgagacccgccaccccacgatgtatccggcaaacacatcaatgataaacgccacatagacgaagccctgccatgtgctgacgtaagtaaaatcagccacccacagctggtcaggtcgttctgccacgaactgacggtttacgcggtcgcctgcggcaacggctttccggctgatggtcgtacggacctttttaccccggagaacaccggcaagtcccataaccgccatgagacgtgccactgtacatctggccaccctgattccttcccgtaacaactgacgccagactttacgcacaccgtacacctgatgattttcatcgtatacgcgctgtatctctctcttcagccagtcgtcgtgctgcgcacgggcactgcgtttatccggatgatgtcgctgttgctgacaatggtaatacgttgacggggcaatatgcagttcgctgcataccggtccgaccccgtactgctcacgcagcttatccagcagtggcatcattttttccagaggcggtcgaactccgccttcgcaaaataagcggaagcctggcgaaggatatcgttactgcggcgcagttcacgattttcacgttccagctctttcagacgctgacgttcagcgctggtgagcccaccatcaccgcccccggtatcccgctcatgctggcgaacccagacacgcagagtctccggcgtacagccaatctttggggcaatggaacaaattgccgcccactgtgagtcatattcatcctgactttccagaaccatacgaatcgcccgctgacggacttcgggggaaaaacgagtatttttagtcatcctgtttacctctttctcagggagtttagtctccaggatttccggggcggttcaaacagccagaatcgctcgcagaggacccggaaaccctcagtatcagctgtgaggtaacgttccggcacgggacgctccgcttcaatggcaatgtcagcgaaaagctcctgactctgctgatacaggaactgaagcgatgatcccgttaccttccgggaccaaaatttggctggttgccggtatcaccgatatgagaaatggcttcaacggcctggctgcgaaagtacaaacggcgctgaaagacgatcccatgtccggccatgttttcattttccggggccgcagcggcagtcaggttaaactgctgtggtccaccggtgacggactgtgcctcctgaccaaacggctggagcgtgggcgcttcgcctggccgtcagcccgtgatggcaaagtgttccttacgcaggcgcagctggcgatgctgctggaaggtatcgactggcgacagcctaagcggctgctgacctccctgaccatgctgtaaatctctttatcctggttgtcacagaataagcccggtaaaatacgggcttatgaacgacatctcttctgacgacatcttcctgctgaaacagcgcctggccgaacaggaagcgctgatccacgccctgcaggaaaagctgagcaaccgggagcgcgaaatagaccatctgcaggcgcagctggataaactccgccggatgaacttcggcagtcgttccgaaaaagtctcccgccgtatcgcacaaatggaagccgatctgaaccggcttcagaaagagagcgatacgctgactggtagggtgtatgacccggcagtacagcgtccgttgcgtcagacccgcacccgtaagccgttccctgaatcactaccccgtgacgaaaagcgactgttgcctgcggcgccgtgctgcccgaactgcggcggttcactgagctatctgggcgaggataccgccgaacagctggagttgatgcgtagcgccttccgggttatccggacggtacgggaaaaacatgcctgtactcagtgcgatgccatcgtgcaggcacctgcaccttcgcggcccatcgagcggggtatcgccggaccggggctgctggcccgcgtgctgacctcgaagtatgcagagcacaccccgctgtatcgccagtcagaaatatacggccggcaaggtgtggagctgaggcgttcactgctgtcgggctgggtggatgcatgctgccggctgctgtctccgctggaagaggcgcttcatggctatgtcatgactgacggcaaactccatgccgatgataccccggtccaggtactgctgccgggtaataagaagacgaagaccgggcggttgtgggcgtatgttcgtgatgaccgcaatgcagggtcagcgttggcacctgcagtgtggttcgcttacagcccggacagaaaaggcatccatccgcagactcatcttgcctgcttcagcggtgtgctgcaagcggatgcgtacgccgggttcaacgagctgtatcgcaatggtgggataacggaagctgcctgctgggctcatgcccgccgaaagatccacgatgtgcacgtccgcatcccgtcagcactgacggaagaagccctggagcagatcggtcagttgtacgccatagaggcggatataaggggaatgccggcagagcagcggcttgctgaacgtcagcgaaaaacgaaaccgttgttgaaatccctggaaagctggttgcgtgaaaagatgaagaccctgtcgcgacactcagagttggcgaaggcgttcgcgtacgcacttaaccagtggccggcactgacgtactatgcgaacgatggctgggtggaaatcgacaacaacatcgctgaaaatgccctgcgggcggtcagtctgggtcgtaaaaacttcctgttcttcggctctgatcatggtggtgagcggggagcgctactgtacagcctgatcgggacgtgcaaactgaatgacgtggatccagaaagctaccttcgccatgtgcttggcgtcatagcagactggccggtcaaccgggtcagcgaactgcttccgtggcgcatagcactgccagctgaataacacatccccgtcaatacggccctcgctgtacgcttacgaaataacgccggatgagcagaaagaacctgtggcggccattgcgccgtctttatccacttccactcagaccagagtcagtgccagttcctgcaaggtggaattccgtcacggtaacatgacgctggaaaatccatcgccagagctgctcacgatgttnatccgcgaactgagcgggaggggaagatgatttcactcccatcaggtacccgtatctggctcgttgccggcgttaccgatatgtgtaaatccttcaacggactgggagaacaggtacaacatgtgctgaatgataatcccttctccggtcacctgtttatcttccgtggccgacggggggacaccgttaaaattctttgggctgatgctgatggtctgtgcctgttcaccaaacgcctggaggaaggccagtttatctggcctgcggtgcgtgacggtaaggtatccattacccgctcgcaactggcaatgctcctcgataagctggactggcgtcagccaaaaacatcccgccttaacgccctgncaatgttgtaaaaaacacctggccgcattataaaaacggccatgagtcagaaatacctcattcgcattgcagaactggaaagccagctccgtcagaaagccagcaactgagtctggttgaagagacggaggccttcctgcactggacgtgccgaagaaaagatcgaagaagatgaacgggaaatagaacatctgcgggctcagatagaaaaactgcgccggatgctgttcggtacccgttctgaaaactgcgtcgtgaagttgaacaggctgaggccctgctgaaacaacgcgaacaggacagcgatcgttacagtgggcgggaagacgatccacaggttccccgccagttgcgacagtcgcgccatcgtcgtccgttaccggcacaccttccccgtgaaatacagcgtctggaatctgaagaaagctgttgcccggagtgtggcggtgagctggattatctgggggaagtcagtgcagaacaactggaactggtgagcagcgccctgaaagtgatccgcacagaacgggtaaaaaaagcgtgtacaaaatgtgactgcatcgttgaagcaccggcgccgtcccgcccgatagagcgtggtatcgcgggccccggattacttgcccgcgtgttaacgggaaaatactgcgaacacctgccactgtatcgtcagagtgaaatctttgcccgacagggtgtcgaactgagccgtgcattactctccaactgggttgacgcgtgctgccagttaatgacgccgctgaatgatgccctgtaccgttatgtgatgaatacccgcaagcttcacactgacgacacaccggtaaaggtactggcaccgggcctgaaaaagacgaaaacagggcgcatctggacgtatgtccgggatgatcgcaatgcgggttcgtcatctcctccggcggtctggttcgcgtactcaccgaaccggcaggggaaacacccggagcaacacctccgccccttccggggtatcctgcaggcggatgcgttcacaggttatgacaggctgttcagtgcagaacgtgaaggtggtgcgctgacagaagttgcgtgccgggcccatgcccggagaaaaatccacgatgtatacatcagcagcaaaagtgcgacggcagaagaagccctgaagcgaatcagtgaactgtacgccatcgaggatgaaatacggggattaccagagtcagagcgtcttgcagtcagacagcagcgaagcaaagcgttactgacgtcgctgcatgaatggatgatggagaagaatggcacgctgtcgaaaaaatccagactgggcgaagcgttcagctatgtactgaatcagtgggacgccctctgttattacagtgatgacggactggcggagacggacaataacacagcggaaagagcgcttcgtgcagtctgtcttggaaagaaaaattacgtgttcttcggtagcgatcacggcggcgagcgtggtgcactgctatacgggctgatcggcacctgccgtctgaacggtatcgatccggaagcgtatctgcgccatattctgagcgtactgccggaatggccctccaaccgggttgatgaactcctgccatggaacgtagtactcaccaataaataagcgtcaatacggtgctccgttgacgcttaccttctttcattcgctgaaggtggaatgtatccacggggaacgctttagcagccgggaaataatgcgggaaacggtgtttaattatatcgagtgtgattacaatcgctggcgtcgtcacagtgcctgtggcggtctcagcccggactgtcttgcactgcaaatattcagaaatgagtctatgcagttcaccagtaaaatcagccatcagagagggaatgtagtggcacagtaaatttggccacctgattaaaggtgatatcctcaccacaacacaaaacaggtgacttaatgaacaagaaaaccaaacgtactttcacccctgaattcaggctggaatgtgcacagctaattgttgataagggctactcatatcgacaagccagtgaagcgatgaatgtcggttctaccacgcttgagagttgggtgcgccagctcaggcgagagcgtcaggggattgcgccctctgccacacctattactccagaccagcaacgtatccgcgaactggaaaagcaggttcgccgcctggaggaacacaatacgatattaaaaaaggc

SEQ ID NO: 174 - DNA  (genomic), 7304 bp; double-stranded, linear
attcctgaaaagaggccggtgttgctaccggcctcaggtcagattagccattctttcttcccgttttcagcccccgatggaaatcgttaattcgcttaatggttttaaccgcacgctgcggcaccgcggaagccaccgaccagacaatcatttccaggcacaacaataccgtaccatgtagtggcgttttccccttttcatccccgcgcggaacatgaatcacgatactggcgtctttgctaaaacgtgaatccagcgcgtttgtcagcaaaataacagggatccccagccgtctcgcttcacgcagcgttgtcagcccttcccggtgcgcagatttttgcgccatcatgatcagaacatcgccacgttgaagcgcaatcagttgctcggcaaggccaatacccgtacggtttagtgccgtggcaggcaaacctatgcggttgaatagtcgtgcggtatagtccgccagaatacccgaagcgccaatgccaaaaattgcgacttgccgtgcctgtaccaacaacgctaccgcttgcgcaagcgcgtggcggttttcaggctctgacaggacattacaggtatacaaatgcccttcaagaacaaagtcgattgcggtgttaacatcgctcgtcaagttactcaccgtcgtagacatcttttcgctggaactaagggctggaccaagccactgttccagagtgcgtttcagatcacgcagcccggcaaaccccagggcctgtatagccctgataactgtggcatcggaagtgttcaacgtggccgcaatttccatcgccgtttgatcgagtaccacttcacgatgctcattaatatagctggcgacagctcttaacccaggcgttaactgactcgcgcgagtgcgaaaacgctcaccataaatatcaacccgcgttttgtctttctgaatcatttggcctccggtaaaggtcgccccgcaatttgtgattgtatctgcgcagccatcagccccagagatgcaaaggagttagaaattgcctcttcacgagaaatcagcacataacgcccggaacgacaggcagtcagaaactgacaccatcccggcatgactttttccattgctgccagctcatcctgaggtttaccaccggtgtcaccgcgccaggttgcaaaaacaaaatcggcatccagttcaggtaaacgctccgcgctcacatccattcgcccaccttcaggaatgctctcaatcagcggcggaaagcgaaaaccagcatcgcgtaatacccgccccagcgaatgatagctatgcatcacattaatttttccctgatttgcctgaatcaccgataccgttattttttggctgtccagcgtcgccttcagcgcattgatttgtgcctgatagcggcgttcaagtatcgccagctgcgactgcgttcctgtcagttctgccagcttgcgatagatttctggcgcgccccctttgagatgatcaatgctcaccgtgggcgcaattttttccagtcgttcaatgggtgtattacgggtcggttctgtgatgatcaggtcaggctttgccgccacaatcgcttcaatatcaatatcagcggtgccaataaaagcgatcgatgaattatcaaagtcgacacctgtcaataacgcgcctgatcgaatgaaatggctaccgtcaggccgagttcgcccgtggctggcgacaggaggtacaccgagctcaatcagaggaatagtgatatcaagatcgtgtaaagagacaattctctttggatgagcaggaacagtgactttgcgccctaaatcatcagtaaagacctgaacaggttctgtcgcgcgggcaaagaatgacaacagtatcagcagagaaaaaaataaacgcatataactcccattaaaaactgttcctgcgctgccagagcagtagcaaaaagaatggtccaccaatcaatgaaataatgattccggcaggcagttgcaaaggcaaaaaagccaaacgaccaatgctatccgccaggatgactaacaacgcccccgatacggcgctccccagcagtaatgtcgtctgcccgccacgtagaataaaacgtgatatatggggtgctatcaatccgacaaaaccgatgttaccaacacacgaaacgcagacggctgtcaggattattggtgcggcgacacgtaacaacgccagacgagaactattcacccctaacccggttgcaacctgatgaccaagcagagcgatatccgccgtcctggcggtgaacagcaataaaagagcggctggcaacatccaacaggctgaaataccgactaacatccagttagcagcatgcaggcttcccgataaccacatcaatgcagtttgtacatctcgaacatctgcagtggtcataaatacaccgataccggcggcgaaaaaccaggaaacaccaataccaatcagaacaaatcgcgggcgggaaatttcgcgtgcacaaaaaatcacgattaaagccaccaacaagccaccagcaagaccagccactggacgccagaacattcccagcattggaaactggaaaatcagccacagcaccgccacgctacatccttctttgacgccgattaaaccaggatcggcaaggccgttacgcgcaatggattgcatcgcggcccccgccatacctaacatggctccgcatagcaatgccatgatgactctcggcaagcgaatatcctgcacaatataacgtgcgtctgtgcttacgttttctggagcaaacaacgctcgtcctacttccgatgccgggacaaaaaaagaaccatgcatcagaccgaatatcagtattccaaccgcaaacagaaacagcccaccaagcaacaccagatttttagggcgtaccagtgtcgaaaacttaccaacacgtagtggacgtagcccgacgttcattatccgactcatttgaacattctcgtcgccataatgacaaaaacaggcgcaccaactaacgccgtcatgacaccggtcgctaactcatggggcgtgaaaagcgtccgagcaataatatctgccagtaataacaaaagcgcgccgacacaagctgaaagagggagcagaacgcgcaaatccgctgataccagacgcctgacaatctgcggtactagcagaccgacaaaaccaatggggccagcaatcgatacggctgcgccacagagcaacgcgatcgcaagcagagtgaatgttcgcgtgcggagtaccgagacgcccagcccctgcgccatgcgatcacccagtgccaacatgttaagagagggcgcaaggtaaatggctaacacaaccccccccagagaaaaccaggcggacgtacccagcgtcgcccaatcctgccccgctaaatcacctgctagccatgtccgcatcgccagcagtgtttgttcgtcaagaatcaggattgcagccgttattgaggatacgaacgccgatagcgccacgccgcataaagtaactttcattggcgttagccctgaacgccctgcggaggaaagcagcaatatcaacaggaacaataacgcgccgcccgtagatgccagcagtgggcgtccaaccggaaaggccagcccaagcgcactggcagcaacgacagcaagagcggctccggcatttaagcctaaaatatgtggctcccccaatgggttacgaatgacagcctgcaacaaagcaccagcaactccaagagaagcaccggtaagcaatgctgccgctaaacgcggcaaacggagtcttacaattacgttgtgatcgaagttttgcggttcaaaatgaagaaatgcctgcaacaccgtttgtggtgcaataaatcgggcaccaatccctggatataccacgcatcccacaagcagtaaggcgaggaaaattacagtaaccagccctgtgcgcatcatactttttctacaccacgaaacggcatgaagaacggctttcccgtcagagtatttattgatgcgtgaacatcaacgtcaaagacagcttttaccagctcaggcgtgcaatgctccccctcattcaacacacgcaccactttcccctggcgtaaaaatatcaacgtatcaccataattgacggcaaaattcagatcatgcaacaccacgacgactgtacgcccgtgatgacgcgttaaatcatgtaataactcaagaatttcaacctgataacgtaaatcaagccaggttgtgggttcatccagtaggatataaggcgtcttttgcgccaacaccatcgcaatccagcaacgctggcgctgcccaccagagagtttttcaacaggtaaatgagcaaactcctgcgtaccggttaatttcagggcctcttctaccgcctgctcgtcggcgtcgctccattgacgtatgaaattttgccagggaaaacgcccacgcgacaccagttcataaacggttaagccctccggcaataatggcgactgcggcaagatcccaagtctacgggataacgctttcgttggttgctcgtgaatcgctttaccatccagcaatattgagccgcccatgggttgcaagacacgtgcaatggtgctgagcaacgtcgactttccacagccgtttgccccaaccagaacggtcattttttctgtgggaacggagaaagaaacaccatcaacaatgattttcttgtgatacccggcagaaacattgtcgaggatcagcccctgcccttttgcgttatgtgccacgtgtacgccaacttaatcaaagaaaaacaaaaataaaactcattctcttttgagagtttgacgccacaaaatgtagtagtcaagaagttaaaagccatacaaaaacaaggtaaataacaggtgaaatatttttaaagataaaaataaaatcattaaatattaataaattaccatcaattgaattgcattaacctctcataaaaacacatgtagcaattttttattatttctcatttactactacattaccgcatgattgaatgattctcaattacatatccgatggtaaaataacaaacggatagtgcttagtgagcaacaagaaacaattttcactcacgacaatccgtgagtttttgggataacagactaaatggctaagttcacaccttcattctcaggaatcaaaggtcgggcgctcttttcactgctctttgcagcaccaatgattcatgcaaccgacactgcaacgaccaaagatggcgaaacaatcactgttacagcggatgcaaataccgcaactgaggcgaccgatggttatcaacctctgagcacttccacggcgacattaaccgatatgccgatgctggatatcccgcaggtggtcaatacggttagcgatcaggttctggaaaatcagaatgcaacgacgctggatgaagcgctttataacgtcagtaacgtggtacagaccaatacattaggcggaactcaggacgcctttgtacgtcgtggttttggtgctaaccgggatggctccatcatgaccaacggcctgcgaactgtacttcctcgcagtttcaacgccgccacagaacgtgtggaagtgctaaaaggtccggcctccacgctgtatggcattctcgatcctggtggattgattaacgtcgtgaccaagcgcccggaaaaaacattccatggttctgtctcagccacgtcctccagttttggcggaggcactgggcaacttgatatcacaggtcccattgaaggcactcagctggcataccgcctgacgggggaagtgcaggatgaagattactggcgaaacttcggtaaagagcgcagtacatttattgccccgtcactcacctggtttggtgataatgcaacagtaaccatgctctattcccatcgggactataaaactccgttcgatcgtggaacgattttcgaccttacgacgaaacagcccgtaaacgttgatcgaaaaatacgttttgacgaaccgtttaatattacagatggtcagtccgatctggcgcaactcaacgcagaatatcatctcaatagccagtggacagcgcgctttgattacagctacagccaggataaatacagcgacaatcaggctcgcgttaccgcgtatgatgcaacgacaggaacgctgacacggcgtgttgatgcaactcagggatctacccagcgtatgcattctactcgtgcggatctgcaagggaatgttgatattgctgggttctataatgagattctgggtggggtgtcatatgaatattatgatcttctgcgcacagatatgattcgctgtaaaaacgctaaagatttcaatatctacaaccccgtttatggcaataccagcaaatgcacaacggtttcggcgtcggacagtgatcagacgatcaaacaggagagctactcagcttatgcacaggatgcgctctatctgaccgataactggattgccgtcgccgggatccgctatcagtattacacgcagtatgcgggtaaaggccgtccttttaatgtcaatactgacagccgcgatgaacaatggacgcccaaactggggttagtctacaaactgacgccatcggtatccttatttgctaattattcgcaaacatttatgccgcaatcgtcaattgccagctacatcggagatcttccaccggaatcatctaatgcttacgaagtcggggcaaaattcgagctgttcgatggtataaccgcagatattgcgctgtttgatatccataaacgtaacgtgttgtataccgaaagtattggtgatgaaaccatcgccaaaacggcaggccgcgttcgttcaagaggggtagaagtcgaccttgcgggagcattaactgaaaacattaatatcattgccagctacggctataccgatgctaaggttctggaagatcctgattatgcagggaaaccattgccgaatgttcctcgtcataccggttcgctattcctgacctatgacattcataacatgccaggcaataacacactgacgtttggcggtggtggacattgcgtaagccgtcgttcggcaaccaatggggctgactattatctgccaggctatttcgttgccgatgccttcgccgcatacaaaatgaaattgcagtatccggtcacactgcaattaaacgtcaaaaacctgtttgataaaacgtattacacctcttccatcgccacaaataatctggggaatcagattggcgatccgcgtgaagtgcaattcacggtgaaaatggaattttgatcaaaaaagcccggtatacacttgtataccgggctatgttttattcttctggcgggaggattatcaga

SEQ ID NO: 175 - DNA  (genomic), 62 bp; double-stranded, linear
ttcggtagcagatcttcaatctcctccggctatcccgcctattgataaagcagaataaagca

SEQ ID NO: 176 - DNA  (genomic), 375 bp; double-stranded, linear
taagtttcccaacttactaacaactcatcagaggggggagaaatcctccctcacccttgttcctttactttaggttgaaaaaaaatcagcgtcaagaaggtttcattaacacatatccctggcccaaaaagccggggattttttatatctgcgttccgctaaaaggtgcaaatgctcaggacgttgcagcgttttgcgtgaccgctcggggaaggcaaaactgcttcagggaaagcgttgcgcggggtccggcgctcatcaacaatcggggagtcagcaaggggctgaaacgggaaagcccctcccgaggaaggggccttatagaaggaaagggttatgatgaagctcgtcatcatactggttgtgttgttactg

SEQ ID NO: 177 - DNA  (genomic), 100 bp; double-stranded, linear
ctgcacctcgccaccggcggatgctgcgtgaacgccttatccgccctacatgttcgttcccgtaggctggataagacccgacaagcgtcgcatccggcgt

SEQ ID NO: 178 - DNA  (genomic), 28 bp; double-stranded, linear
gaaaaaggacgcggaaagattgtccgtc

SEQ ID NO: 179 - DNA  (genomic), 2326 bp; double-stranded, linear
gatggcggagaacgccgatactcgcggcattgaacgcgtaaactatctggcactgctggcactcggcactttctattttctctgcgctttcctgcctatctacttcggcgcggaacatgcaaaaaccatcattgatgtcctgccgcaacgattaatcgacggcctcggcgtcgcgggcggcatcatgccagcaatcggttttgccgtgctgctgaaaatcatgatgaaaaacgtctacatcccctacttcatcctgggctttgttgccgcagcctggctcaagttaccggtgctggctattgctgccgccgcgctggcgatggcgctgatcgatctgctgcgtaaatctcctgaaccgactcaacctgcggcacagaaagaggaatttgaagatggcatctaatcaaaccaccctgccgaacgtcagtgaaaacgaagaaacattgctgactggcgtcaatgaaaacgtgtatgaagatcagagcattggcgcggagctgacgaaaaaagatatcaatcgcgtcgcctggcgttccatgctgttacaagcgtcttttaactacgaacgtatgcaggcttccggctggttgtacggtctgctgcctgctctgaaaaagatccacactaataaacgcgacctggcgcgcgccatgaaggggcatatgggtttcttcaatacccatccgtttctggtgacatttgttatcggcattatccttgcgatggagcgttctaagcaggacgttaacagtattcagagcaccaaaattgccgtcggtgcgccgctcggcgggattggcgatgcaatgttctggctaacgctactgccgatttgtggcgggattggagccagtctggcattgcaaggctccattcttggcgcagtcgtctttattgtgctgttcaacgtggtccacctggggctgcgttttggtctggcgcattatgcttaccgcatgggcgtggcggcgattccactcattaaagctaataccaaaaaagtcggccatgctgcgtctatcgttgggatgacggtaatcggtgcgctggtggcaacctatgttcgtttaagcaccacgctggaaatcacagcgggcgacgcagtggttaagttacaggctgatgttatcgacaaactgatgcctgccttcttaccgttggtctacaccctgaccatgttttggttggtacgccgcggctggagtccgctgcgtctgattgcagttaccgtggttctcggcatcgttggtaaattctgccatttcctttaaatacaatgaggtattagatgttaagtattattttgacagggcatggcgggtttgccagcggcatggaaaaagcaatgaagcaaattctcggtgagcaatcgcagtttatcgccatcgattttccggaaacctcaagcaccgcgctgcttacatcgcagcttgaagaggccatcgcccaactggattgtgaagacggcattgtttttctgacggatttgctgggcggcacgccgtttcgcgtagcttcaacgctggcgatgcaaaaaccgggctgtgaagtgatcaccggcaccaatttgcaactgctactggagatggtgctggagcgcgaagggttaagcggtgaagaattccgtgtacaggcgctggagtgtggacatcgtgggctgaccagtctggtggacgagttaggccgctgccatgaagaatgtccggtcgaggaagggatatgacacacgttctgcgcgccagaaggctgctgactgaagagggatggctcgatgaccatcagttgcgtattgctgacggtgtcatcgcagcaatcgaaccgattccagtgagcgtgactgaacgcgatgcggaactgctctgccccgcttacatcgacacccatgtacacggtggtgcgggcgttgatgtaatggatgacgcgccggatgtactcgacaagctggcaatgcacaaggcacgcgaaggtgtcggcagttggttgccgactaccgtaaccgcgccgcttagtaccattcatgcggcgctgaaacgtattgctcaacgttgccaacgcggcggacctggtgcgcaagtgctggggagttatctcgaaggaccgtacttcacgccgcagaataaaggcgcgcatccgccggagttgtttcgcgagcttgaaattgccgagctggatcaattgattgccgtttctcagcacaccttacgcgtggtagcgctggcaccggaaaaagagggggcattgcaggccatccgccatcttaaacagcaaaatgtacgagtgatgctggggcatagcgcggcgacctggcaacaaactcgcgccgcgt

SEQ ID NO: 180 - DNA  (genomic), 1307 bp; double-stranded, linear
gaaccgccccggaaatcctggagactaaactccctgagaaagaggtaaacaggatgactaaaaatactcgtttttcccccgaagtccgtcagcgggcgattcgtatggttctggaaagtcaggatgaatatgactcacagtgggcggcaatttgttccattgccccaaagattggctgtacgccggagactctgcgtgtctgggttcgccagcatgagcgggataccgggggcggtgatggtgggctcaccagcgctgaacgtcagcgtctgaaagagctggaacgtgaaaatcgtgaactgcgccgcagtaacgatatccttcgccaggcttccgcttattttgcgaaggcggagttcgaccgcctctggaaaaaatgatgccactgctggataagctgcgtgagcagtacggggtcggaccggtatgcagcgaactgcatattgccccgtcaacgtattaccattgtcagcaacagcgacatcatccggataaacgcagtgcccgtgcgcagcacgacgactggctgaagagagagatacagcgcgtatacgatgaaaatcatcaggtgtacggtgtgcgtaaagtctggcgtcagttgttacgggaaggaatcagggtggccagatgtacagtggcacgtctcatggcggttatgggacttgccggtgttctccggggtaaaaaggtccgtacgaccatcagccggaaagccgttgccgcaggcgaccgcgtaaaccgtcagttcgtggcagaacgacctgaccagctgtgggtggctgattttacttacgtcagcacatggcagggcttcgtctatgtggcgtttatcattgatgtgtttgccggatacatcgtggggtggcgggtctcatcgtctatggaaacgacattcgtgctggatgcgctggagcaggcgttgtgggcccgtcgtccgtctggcaccatccatcacagcgataaaggctctcagtatgtgtcactggcctatacggagcgactaaaagaagccggattactggcatcaacagggagtacaggcgactcgtatgacaacgcgatggctgagagcatcaatggtctttacaaagcggaggtaatacaccgtaagagctggaaaaaccgtgcagaagtggaactggccacactaacgtgggtggactggtataacaatcgacgattgctgggaaggctgggccatactcctccggcagaagcagaaaaagcttattatgcttccatcggaaacgatgatctggcagcctgagttcacagataaaacactctccaggaaaaccggggcggtt

SEQ ID NO: 181 - DNA  (genomic), 54 bp; double-stranded, linear
ctgtcccagcgccgcctcctcagaaaagagtcggcgctgaaattctcctttcgt

SEQ ID NO: 182 - DNA  (genomic), 53 bp; double-stranded, linear
tccgcaaccccatgttttcacataactgttgcgttgaccaattgaatctacag

SEQ ID NO: 183 - DNA  (genomic), 674 bp; double-stranded, linear
caaatctgagcctgacgcaagcatcgggcagaaattaatcgcaacgcgcagattgcgagctgcattccacgaaatttgtaaggttgtgaagatagcgtttttcaccggaatcaggttaacaaatcagcgctctctctgttgctgagcatccggagttattcgatggtgatactccaattacagaggatgttttatggacactacccttccctttctaattttgtacgcttgtttatcagccctactttttttctgggatgcaaagcatggcttgttacctgacagatttacgtgcccgttactctggtcaggtcttttgttctatcaagtttgtcatcctgatggtttagccgatgcgttatggggggcaattattggttacggcacattcgctgtcatttactgggggtatcgcatactgcgccataaagaaggattaggctatggtgatgtgaagtttctcgccgcccttggcgcctggcattcatgggccttcttaccacgactggttttccttgctgcctcattcgcttgcggagccgtagttattggtctgctcatgagaggaaaagaatcattaaaaaacccgctgccttttgggccatttctggcggctgcgggtttcgttataggctgggatagtttgctgataggccgttaatcattaactttaa

SEQ ID NO: 184 - DNA  (genomic), 73 bp; double-stranded, linear
gcacagttttatttgcgccatagttcagcgagcaaaattacgactaaatatttcgagctcaaattacgggcag

SEQ ID NO: 185 - DNA  (genomic), 889 bp; double-stranded, linear
tatagcgtttttatgtacactctttatactgtatataaaatcgcactacaggctcatgaatatgaaaccggaaagcaaagaagcgccaatcaatatcagagcgaaagcctcacagcgtgacctgattgatatggcagcgaatctggtcgcaaaatcgcgcactgattttatgctggatgccgcatgccgtgaagcgcaagacatcttattagatcaacgactattcatccttgatgacgagcaatacgatgcgtttctcgctgccctggacgcccccatcactgctgagcgtcaggccaaaattaacgcgttgatgaatcgtaaatcgccatgggaataacggctcctactcccctaacgtctgaacataatctggctgacttttgctgttccgatcacgggatgaatgaatggctaaaaaagaaagcgttaaaaaatcacagctccggtctgtctcgtgtttacgttatctgtattgccaatacccgccaggtaatcggctattactgcctttctacaggcagtattcaacgtaatttggcccctggagccatgcgacgtaatgctcccgaatcgttgcctgttgtcgtattaggcagactggcaattgatcaagcctgggcaggtaaagggttgggcgtcgcattgttgaaagatgcagtctatcgcacaatgtccatagctcaacaggtaggggttcgtgcgctcattgttcatgccttagacgattcagtacgcaatttctatctgaagtatgcctttgtaccttcaccattccagtcacttaccttactgtatcccattactctggagtaatttacctctaccggatagtcacactgatgagtctgatccgggagggatttcaatcagtgagtttggttatcat

SEQ ID NO: 186 - DNA  (genomic), 2906 bp; double-stranded, linear
cttccgtatctggcttctatttttgctacgccactggcaataatatcccaacgcaaaaccaagctgtgcacttatcggaccgacaaagtcgatccactgttgagaccaaaatggcgaaaaattcagtgggagccagacaactgtcagaaagaaactgcgcatattttccagcaaagcaatttgcgctggcgcgacataaaaaatgatattccacaggagcaaccagaaataaactggtgcaaataccagccaacaatgcagtctgcttttcaattcaggtggcgttctgcgcgcaaattgccaaccaacgcccaccattgcacagaagaaaagcgcatattcagccgataaccatagttgtaattgcagaagggaaatacgcctgtgcatgagcgggattgagaacagtatttctcccagaaaactcagcgtgattacacaggcagccagcgcaaccaccgtcggccacaccaacaacggtacaataacaaagccgagaaataacggataaatataaagtctgattatattcatcattattgtcctgatgattcgggggatgcttcatacagcggcacataccccacatcctctaccaactgttgcccctgctgacttataaaccagtcaacaaatttctgcgtttccggcgtgggattttcacgcgtcaccatataggcatccacaatgtatggataagtgccgttgcggatattttcctcggtaggcgcaacgccatttatagccaaaagtttaatctgcttgcgcattttgagcatattgtcattcatacgagtgacgtaatagtggaaggtgtacccaatggaagatggcgtgttttgatagtcggcaacttcagtaattaaaccgcccataagatcaatcacagtggattttttagctggcagcattggggtgtcttgcataaccaaccccttcataatcgtttggcttccagaatcttcagggcgctgccagacttttatatgttcgtcactaccacctactttattccagcggctagttttgccgctaaaaatatctttaacctggtgctcagagagagaatttaccgggttattaatatcaacgataaagacaaaggcttcgcgggcgaaagcggtatatttcagtttaacacccgcttcttctgcacgttttttctgtccttccgacggttgtgcaacaaaaataaccgtcgcggaacctttaatcagactatcgtaggcttcagctgttcgggtttgctgcaaaccatacgcctgccaggccagcgaggttcgatccttatcttttggctcgggtactaatttataatacgcggaggcatacagcgggtataaggctgtagcgccgtacactctcggccatcttgaccaatcatcgctgtaacgtaatgcaggttgcccccgcagagacgtcagtccatggctctcttcttccctgacgctgttatagtacccttcccggtcgacacatcccgccagtaacgccgtgcctaatagtaaaacaccggtgaatttattcatctcgctgattcctttctctcgagcgttattccattgttagatacagcggcacatatcccacatcttctaccagactctgcccctgcggcgttaaaaaccattcgaccagtttttgtgtttctgacgttgtattttctctcgtcaccataaatgcatcgacgatgtacgcatatttgccgttgcgaatgttttccgccgtcggtgtaataccgttaatcgctagcaatcttatatttttatcagcattcatttgcgtcgcgtaatagcggaaggtatagcctattgcgttgtttgtattacggtattcggcaacgactttaatcattccctccatcacgcttgccacttccgtttcctgcggcgagatcatgcggacttttttcatgacctgtgattgcatcactgtctggctgccagagtcttccgggcgctgccaggtctggatctcctgatcgttaccgccaacagtacgccaattggtaattgcaccactgaaaatgtcacgcacctgttgttcagtcagggaattaaccggattatccgcattgacgatgaaaacaaatgcttcacgggcaaatggcgtgtatagcaaagtgacgcccgattcctcagcgcgttttttctgcccgccggagggttgcgccacaaaaataatatcggcatcacctttaacaatccggttatatgcatcgggggtacgagagttctccagatattcccaaacgtgaaaatcctctggtattacacttaatgcataaaatgcagaagcataaattgggtacgcagccgtggcgccatcgattcgcggccagttttgcctaaactgaatttgcggtttgccacgcagcggcgtcagtcgattattgagtttatcgggtcgccaggccctgatatcaatattttcgcgtacaccgacaccaggattttgctgcttatataaatgggcctgatacccggcgacaataccaagtaagagaagtagaaacaggagtaagttacggcaacgtagtccggacgtgccggataaaggatatctggtcggccaggcgtatcccagcgaaaaactgatatgcgccccaacgggaataatgaccatccaccagtactcaccacccactaatgagactaaaaaaacgcccaaccagggaagcataaggtttgccaaccaaccagctcccatctggcgaaattgataatctgccagatgtagcgtgattatccagccaaccagggttaatagcgcgggtaagagaaaaaagcattgccgccagacggctatttctctgttttctggcgcgctatcaccggcccacacgcgaccagagaaaaatattattatcgcccccagcgtcagcataaagacgttgagtagaagat

SEQ ID NO: 187 - DNA  (genomic), 3511 bp; double-stranded, linear
gttcaaacaggtgctgcacacaaccagacgcggcacctgttttattacctgaactgataatgaccttcgcccaatcggataacccttccctcttcttctgcgcggttcagccacacactaatttgttcgatggttaaaccagtacaagacgccagcctttcaatacttatcgattcctttgcaaggatcgccagttccgccacaaagagttgataaaaatcgacaggcgtatacgcgggcattactgcgtaatttgcgtcatcttcatgcagcgaaaacagttctggttgagcgttacggagtgctctgtcatacatcagcccaggaacgtctggcagtctgatcgtcacattctcagcctgttcagcactccatgacgccccattttctactaatcgtgaattggctgattgcatatcctgatttggtttaacctgcacaggcagccactgatgttttaatgcctccatcgccccggttatcgttccaccggtcattcccgcacgtacaaccattgcgctttcagcaaggcaataaatatatttatttcgcgccatcgcattgccgacggtgaaacgtacctctgggtaaaacggcgaaatcaacaccaggttgcctgctataagcccttcacgccatttcactaacgtactcgtttttaacaagctatcagctaatacgccaacggcagttcccccggcctccagtgccgacgccattgcacattcatcaatacctcgcgcaccaccagagataacgcaaatcccctgttgggccagtttcgcggccagttgttgggtatagcgcaaatcgtcagtcggagcatctcgcgagccaacaatcgccataccttccgcttgcagtaatgctttattcccgcagccaaataaaacgggaggtgcatccgttcgcaatcggtttttcaagcgaacgggataatcagcatctccgcgggttaagatccataaaccggcgcgttgccacttatctaccgccaacgccagactatgaccacgcgccagcaagccaagaatacgctcctgagaaatacgcggatcgctccagcctgtaagtttctcttgcggttgcggcaccagaagctcggcgggactgatacgttggtgcttcagccataatgcaaacttcccccattcactattactaagaggtttatacttactcgccgccgcgcgagaaaaatcgctggttagcaggagagttgcttgtgcattggctgaaagattcatcaattttttaccgaggtagaagcaagggcaagaggataaaccgtcgggcaacctgcctggcgtaacagtgctgttagaactgtcagcgtccatgcagaatccacgatatcgtcaaccagcaacgccggaccaggcatcaaaggaggggtaatcacaaacgccccgtcgagattttgacactggtggaaacggttttgctgcattttctgcggtggattgtccacgactttttcaatggcatcaataaaaggtaagccaagtttcgccgccagtcgccgggcaaaatcaggaaccaggtcgaggtgctttcaaaatcaggaaccaggtcgaggtgctttaatgaaggaacgcagcatacccaggttggttcaggatgcggattccagcgttggcgaaccatttccgcacatgcctccaccagttcatcactgaatcgccccgtttttttctcctgtgctacctgctttccccacccggaatatccccaacgagaaaggattcgccccgtagatccttgtaaactcgcaggcaagttccctttaaatccgtattgcgtaaaagccccagctgccacctgtttattgagatttaatgacaggtcagcgtgtttaataaataagtttgccgcatggagtaagccgctatcaatgtcgggcgacaacaacggatgctgaagacaactgctacatttaccacaatgttcggcacctggctcatcgagtgcgcggcgcagaaattgcattttgcactccttggtcgtgatatagctttcaacgtctgccagctcactttttctctgattcatcaaatggttaattcgttcatggtcaggagaaaaactgacaattgttctgcgccataatttctcggtatacaccacaggcgatggattttcagctaccaataatttcagtgctttttctatttgcccataacggagattcgtccgttgttcaatgcctcgtaaggtaagaccgtcattcacgctaagtacgttgagtatttcatgaatttgcgcctccgcaggaaaggcgctttcacggaagaatttatgaatagcacggtcttcactgccgcaaagcagtatgccaacagcagaatcgataccgcgaccggcacgccccacctgttagtagtaaccaactatcgaacctggcatctggtaatgaataacaaaccccaaatccggtttgtcaaagcccattcccagcgccgttgtcgcaaccagcactttaattttatttgccagcaacgcctgctccagatattccctggcagtattagaatcttccgcgccttcacaagtcacgccgctgtagtaagcaaatgcactgataccatttttccttaaccactcggcgacaagttcggcatcgcgagtagtcagggtataaacaattcccgatttggaaaactgagggataaccgttgctaaccatgccagacgggatgagtgttcacctaagactaaggcatcaagcgccaaactttcgcgagccagcgttccacgctgaatcacaatgtcacccaattgctgacggatatcctcaacgacacggttattcgctgtcgcggttgtacccagaacaggggtattcgcaggtagttgcgcaaaatatctaatatacgtcggtaatccgggcgaaaatcgtggccccaatcagagatgcagtgcgcctcgtcgaccacaagcaagccaatatgatcggctataggatataaaaccgtttcgataaagtcctggtttgccaaacgttccggggaaaccagcaagcaatcgacctcaccttgcagcaacttatcgctaatgcgctgccattcttctctgtttgtagaattcaacgtttcagccgtaatacctaaccgttcagcggcggcaacctggttacgcatcagggcaagcaaaggagagatgataattgtcgggccagcgccgcgatcgcggaagattttactggcgatgaagtacacagcacttttcccccagccagtgcgttggacaaccagcagttttcgccgttggttcaccaccgcgtctatggcttcccattgcccttccctgaaagtagcggtggtatttcctaacatccgctgtaaaagcaattcagctgcgtgcttttccatctttatctcctgcgatctttaggcagtgattagaacggattatttgcaggtaaatttgcgagagagatcaaaaagatgaagagaggagaaaagagaaatgaattactgcgagcaagctcgcagtaatttgtcgcagtaat

SEQ ID NO: 188 - DNA  (genomic), 1819 bp; double-stranded, linear
gaatattctcaaattgcctgttaccaatgtgaataattagttttgttcatctaatttgagtttttccttatattaccaccatcattttgaaacaatttgtaacatcaagagacctttgaatcattactcgttaatatttcttattaaagagaacatattttcgcaagcaatagttattactgtttgtttatggatagagagtctacttaatgggtacagcagctataagtcatttacgatatgatcttaacaaatatgccctttctttacgcaaaaccgcaacacttgcttcaacattttttattgagtccccattagttagattcgagtatctgcaagaaatagaaaatactattaatgatattactcacagattcaattcttcatatgacatcaatgaaaaagcacgacttatcaatgaattaaaaatggagtcagaaacagcaagaaaagaatatcaacttttcagacaaggaaattatgataaatatatcactactgatattttcgaagaacatggtttgataaaatatgtgaacttaagtttcgatattgttgcatctgtaggacaggtcgtaggcggggttggcgcgttgaaatttggtaaggtagtgcattcaaaccgaataaaaggtataggcgtcacattagttgctcatggggcgaataatttttatgaaagcttatcacctttattttttaacgagtatgattcaggtccaatacgtgaactctacagagtaatagcaaaaaaaatgggaggtgatattaattctgctgattatgcatacagcatcgtggacttttcgattactgcatatggtggatattcaggcatgaaaatcgtacctaagtataatagattgattcgtccttcattaggaaatagacctggtacaggacgattatttcattacacatcagttgattttaaaaataaattctcattaaaacctacccctttaaaaatcatacaaattagttctactgtaaaaaaattcaaggttacattttatgatgaaaatacaaatttgaggataaaacatggcctcaataatcatatgccacatcaattattaatgaatatatcaggaactacaactggtgcaggaatacaataacagaataacttaattttaagataaaacattttgaggcataattggtaagagaatttagtatccagttttctgtgtatgataagaatagcgaacatggcaatactaacgattgaagacagaaaaaaacttttcaacatattatcctgaaaaaatgagaatacaagcaatatcccattaactatacttaccaacccaaaccccaaagagcaataacccaccattgaaataatagcatcaatgaaattttgttctacgagagagacttcatgcttattagcaagtttcttcatttctttgtatcttgattttaaatagaagagttcttgtttattaagtacagagagaatcacgtattttgctttcattattcccccttaaaaacactttacaaaatcgatcaaagtcatgatgaatgccattatgcacataaacaacacaaagcgtgatatttaaatcaataaattacactctaaaatgaactataactacagtttatttaatagcatagttaattcctttcctgaatatcaggaagtaattatcgcacgtcctattttcacggtaaatgaaagactattctgcatactcttgaaaagaaagcataacctaagccccttaaaagcattcaggataattatgattatatattacggagcaatagtaaaagcaatccagacactaatttatcttgttcaaga

SEQ ID NO: 189 - DNA  (genomic), 1041 bp; double-stranded, linear
cccgagaatgcactgaaaagaggcgattaacggccagctaatcgccagaactccttaccatgaagagcaaaaatggcagcaaattctgcgtccaattttgctgcccgatgagagctacatttttcaattttaacaaaagattgccgcgacactggtctaacggcaaagaagattttcattgcaccacactctgcttcagccgctcattggcggtcttaatccattcccggtggtgttttctataatgaggtcttgagcgtttagccgtatcaaccacggcaacatactgctcgttggcttcacgtaaccgactcattttcgccaacatttccgcatagtaaatacgcgcctgcgggccggggtaataagaaatcaatacttcaaactcgctttccgcatcagcgtatttttcttgtgcggctaacgttctggcaaataacaaatgcccgtctgccgactgaaaatcagggttataacgcatcacatcttccagcgtctgctgacaggcggcgaactcctgaatagcaaactgtgcctgcgccaggcttagcatcattgccgcttcatgggcgaatatcccgcttaacgcctgctgataatggggaacagcttcgtgataacgccccagacgcgccagttcattagccaacgcataatggttttgattcgtctcggcaatcgccagttcttcggttaatttgcgcaggtggcgctcagggttgagtttgtcctgcaggcgcatcagcaaagtatgcccgtgacggtcagcgcccgtttcaggcagcatcactatgacgaaatacgccacgcagccaatcaccggaaaacagaaaatgataaaaatccagtaccgctcttgtccggtacggtaagcgtgaatacagcaaagcagttcaagcatgacaacaacggcataatgcatgggagggaacctttccgtggcaaataagtggtctggttttaatcctcccggtcagttgaaacaagtctgtatacggacgaataacccggcagaacttagctgccgggttatcgataatt

SEQ ID NO: 190 - DNA  (genomic), 943 bp; double-stranded, linear
tctgtgtaaaaagcagttcaatggatttggttgggaaaaataacgcattttcgttttccccgactaaagggataaagcccagcgatttataaaacgtatgggctttttcattcagcgcctcgacaaaaagaccgtgaatacctaccgctaaagaggctgaccagacgacgttcatggcatgagcaaccagtgttgctccccatccctgcccctgtaatgaacgatcaattgccagacgcccaagagtaacgctgggaatatttttgtagggaatttttttctgtttcgatttcgagggcaatgcggctcgttcaaaacaactgccgcataatgtgtaatatcccagcacctgacgttctggagtgttgcgacaaaggatatacgctcgcagaattttgttgcgatgttgacgaacgagatgtgtcgtcagaaagagatttaacgcttcctcgccgcagtcgaatcgctgtagatcataatctgcatcatcggtcagaatctctatcgtcagatcatccataaattattacattccctgaagacgttttgccgcacgttttagcttttcacctggtgacggtggattactcagcgcatccatcacccgcgtccaggattcctcattgaggatcacccgccgatgctgttcaatcacttccgcagcccgctgcgaagcgctgttcaacataaattggctgacggactgattagatatcgctgccgcttcctcaatcatacttttgtcatcgtcagttaaacgcagatcgatacgctgctttttaacagcagacatgtgaactctcctgctccgtataatatgtacggtatgtcaccgtacattaagcatatcctggattgtttaatctttctacaaccatttcgacaaacacaaaaaaacccgatggcagttcagcgcatcgggcattttcatttatctatctgt

SEQ ID NO: 191 - DNA  (genomic), 15393 bp; double-stranded, linear
taatagcacctcctgagcaggcaatggccaccgtttatctaacagtggccatttgatttgaggaaatgatgaaacattattcagaaaattaatttaaaaaaaccattccttaagtcaaatatatataaacgccgaatagcgattaaatccttctcaaagaatgcactgataacattgtgttatttttattgcctcatttttctcactcacttatagttggtccctgctggcagtaatttagtcatttcagagatttttactctgatgtgcacttactgacttatctcacaagtaattttttctctaaataaagaatagtgatgccagcaattacagttaaaacttgctttactcgtaaaaacaatactttaatggggttctaatgagacattacatgaaatggtttgcggctattgctgttgtgggtgctttagcaggttgcgcgcgtactgcgccaattgatcaggttcactcaaccgtcagcgctggtcatacccaggaacaagtgaaaaaagcgattctgaaagctggcgttgaacgcaaatggattatgtccgaagccggacaaggcataattaaagcacgtcaacagtcacgcgatcattcagcggaaatacgcattaactacacggcatccagctacgatatcaattatgaaaatagccagaacctacaagcgtcaggcggacaaattcataaaaactacaatcgctgggtccgcaatctcgacaaagatattcaactgaatttgtcagcgggcgcagatttataattcttcctaaagtcgggccgttgcggtccgataataatttaattccctcttaacaggttgtgcccaacatgtacgaacaggattctcttagcgcactggatgcgattaccgaagctcaacgcattgcctttgcccctatgctttttcaaacagcactctgcctacgtaatgcgggtgtactttcatatctggatcggcaaggcaaacatggcgcaacgctggctgatatcaccgaacatagccatatcaacgaatatgctaccagcgttctgttagatatgggcttaagcgggcgaattattacctgtaaagagggaatttattacctggcgaaaatcggtcattacctcctgcatgacactatgactcgcgtgaatatggatttcacccaggatgtctgttaccaggggctcttcttcctcgccgattcactcaatgaaggaaaaccttccgggttaaaagtatttggcgactggtcgacgatatatccggcactttcgcaattaccagacgccgctcgtgaaagctggtttgcgtttgatcattactattcagatggcgcatttaacgccgcactgccttatgtattcgccaacaaccccacaacattgtacgatgtaggcggcaatacgggtaagtgggctttgcgttgctgcaaatacaatgaaaacatcgccgttacgttattagatctgccacaacaaatcgtactagcgaaagaaaatatcgcgaatgcaggtttttctgatcgcatagatttccatgcggtggatatgctaagcgatgccccattaccgggcgaggctgatatctggtggatgagccaatttttagactgtttttcacccgaacaaataattagcatactcagcaaaattgccagcgtaatgaagcctggcgcaaaagtttgcatcatggagttgttctgggatgcgcagcggtttgaagcagcatcgtttagcctgaacgcgtcctcactttattttacctgcatggcaaacggtaacagccgtttctatagtgcagagaaattttacgactatctgaataaagcaggattccaggtagcagagcgccacgataatttaggcgttgggcatacacttttgatatgccaaaagaaataatcgtcacttaataattttggtttaccgcgggcgcgcgttgatgaaatttgcattaaacattctcgactggcaggcaagagcgcctggacttagtgaaacgctgcaatggcaggagtggtcacgtcagcctcaggcaattgacccgacagcaccgttggcaaaattaagtgaactgccaatgatgaccgcccgccgcctcagctccgggagcaaactggctgttgaatgcggtctggcaatgctacgccgccatcaaccagacgccgttttgtataccagtcgtcatggcgaactggagcgcaattaccgcattgttcatgcactggcaaccgaacaggcgctttctccgacggacttcgcgctctccgtacacaactcttccgtgggtaacctgaccattgcggccaaacagccgagcgtttcgtcatcgctttcggctggtcgcgatagtttccagcaaggtttgtgtgaagtgcttagcctgctacaagcgggataccagcgcgtgctgatggtcgattttgacggtttcctgcccgagttttatcacccacaactgccatcagaaatgccgacctggccgtacgccgtcgcgctggtgattgaagctggcgatgactggcaatgtgaaacgcagtcagccattgcgggcaatgaaacaacactgccgcaaagcatgttgtttttacagcactatttacaaaatgtagacacattttcactgcctggcgagcgcgtgcaatggcgctggagccacagatgagtaagctgatgtcacgtctggagtggacctggcgactggtcatgaccgggttatgttttgccctgtttggtctcggcggcctgctgctttctgtcgtgtggtttaacatattgttagttttggtgtgggatacttcccgccgccgtcgtttggcgcgtcgcagcattgccgccagttttcgcctgtttttaactgtcgcgaaagggcttggcgtactggattatcgtattgatggcgctgaaatcttacatcaggaacgcggttgcctcgtcgtagccaatcatcccacgctgatcgattacgtgctgctggcgtcagtcatgccagaaactgactgcctggtgaaaagcgcgctgttaaaaaatccttttcttggcggcgtcgtgcgggcgacagattatttaatcaacagcgaagctgaaactctgttaccccgctgccaacagcgactggcacagggtgacactatcctgattttccccgaaggcacacgaacgaagcccggtgaaaaaatgacgctgcagcgcggggcggcgaatattgccgtgcgctgcgccagcgatttacgcatcgtgacaatcggctgtagcgagcatctgctggataaacaaagtaaatggtatgacgttccacctgaccggccgttttttacggttgcagtccatggtcgggttgaaatcaataaattttacgatgcaacttcacaagaaccggcgctggcagcaaggcagttaaaccggcatcttttgcttcaattacaacaaggttgtttacctctctcaggaataaataatgcaagcgctttatctggaaattaaaaacctcatcatcagcaccctcaatctggacgagttgacgcctgatgatatcgataccgacgcgccgctgtttggcgacggtttagggctggactctatcgatgccctggaactgggactggcagtaaaaaatgagtacggcatcgtgctctctgcggaaagcgaagagatgcgtcagcactttttctccgtcgccactctggcctctttcattgctgcgcaacgtgcctgaggaaagccatcatgacagaacaacaaaccgtctatcaggaagtctcagccctgctggttaagctgtttgaaatcgatccgcaggacatcaaacctgaaacgcgcctgtacgaagatctggaactggacagcatcgacgccgttgacatgattgtgcacctgcaaaagaaaaccggtaagaaaatcaagccggaagagtttaaagcagtgcgtacagtccaggatgtcgtcgaggctgtagaacgcctgctacaagaagcctgatctgatgtcgggcattcgctcgctaccgatgattaagctgctgactggattattgctgctcgcctggccgtttgtgatttggtttggcttagcgcataacggcctgcactggctgttaccgctaatggcgttgctgcttttgttgcgtctgcgccagacccgtcgccaggcggggcctttacaagccgtcacgcaactcgtcgctgtcgtgggcatcgcattatgtgtcgccagctttatgttgaaaacgcaccagctactgctgttttacccggtagtggttaacgcggtcatgctggcggtttttggcggttcgctgtggtcggcaatgccgatagttgagcggctggcgcggttgcaggagccagacctcccggaaaagggcgtgcgctatacccgccacgtcacgcaaatctggtgcggctttttcatcattaacggtggaattgccctctttaccgcgctttatgccgatatgtcgttatggaccgcctggaacggcatgattgcttatttgttgatggggacgttaatggctggtgaatggctgctgcgccgtcaggtgatgaaaagagatcgcgcatgaagcagaccttaccgcttgcacgctggctgactgcgccacgccctgatgacacacccattgcgtggctgaacgaaagtacctggacgctgggcgatttgcgtcacgatgtcgcgcaacttatctgccgcttgcagcaacagccgggtgaacgctgggcgctgtgctttgagaacagctatctgtttatcgttgccctgctcgccacgctacacgccggaaaaacgccggtgcttccggggcataaccgtgttatccagcttaacgagcaacgtgaactttttgatggtgtgcttagcgacagcgaacttaactggcaaggttcattgctgttggtagcaagttctccacaaatcgcgacacaatccttcacctttgccgctatagcgccagaggcttttatcgagctgtttacctccggttccacgggacagccgaaacgggcgattaaacctgttcatttgctggatcgtgaagcagaactgctggctgaacgattaggcgcacgtctggcgggttgtcgtgtcgtcggttccgtattgccgcagcatttgtacggcctgacttttcgcgttttcctgcccatggcgttgggattaccgctgcacgccgccatgctctggtatgtcgaacagtttgccgcgttgagtcatcagcatcgctatatcttcatcagcagcccggcatttttgaagcgcctggatacccagctttctccgccacccgttcaggtgcttctctctgctggcggtgagctgccgtggcaggatgtacaacataccgcgagctggctgcgcgtctggcctgatgaaatctacggcagcacggaaactggcgtcatcgcctggcgctaccgcgaacaagagcaacgccgctggctacccctcccaggtatgcagttccaggccgaaggcgatgcctttcgcctcttttcaccgctgatagcggaagataacggcatgttactcgacgatatcttacagtttagcgaagatggtcagttccatctgatggggcgtcgtgggcgcatcgttaagattgaagaaaaacgtatttcactccaggaagtagaacaacgtctactggcgctggacggcattcgcgaggcggcggcagttcccgttacgcgcggcgggcgtcagagcataggcgttttgctggtgctggatgacgaagctcatctgcaatggcagaacggcggcgggcatagccaggaaatgacctggcggcgtttactgcgcccgacgctggagccagttgctattccgcgttactggcgcgttattgatgaaatgccagtaaacagtatgaacaagcgtgtctatgcgcaattacaggagttatttcatgaagccccatgaaatcgagcgccatcaggcacaaacgaatcaccttgaaattgttctgcatctcagggcggatctgttctggtttcgcggtcattttgccgtgcaaccattactcccaggagttgcgcaaatcgactgggcgatgagctacgcgctcaatctgctcgcgcctggctggcgttttcactccattcagaacataaaattccagtctccgttgctgccggaaaaccgcgtcacgctcgcgcttaactggcaggaagaacgccagattctgagctttagctatcagcgtcacgacggtgacgcccgccacaccgccagtagcgggaagatccgcctatgtcggtaaacttttctccctgcgtgttgataccctgctacaaccacggcgcgatgatgccgggcgtgctggcgcgtcttaagccatttaatctgccctgtattgtggtggatgacggcagcgatgccaccacacaacagcaactggacagtctgcttgccgaacagcctggcgtgaccttaattcgcctggcagaaaacgcaggcaaaggcgcggcggtgatgcgtggcttacaggcagcggcagacgcagggttcagccatgcggtgcaggtggatgctgacggtcagcacgcgattgaagatatccctaaactgctggctctcgctgaacaacaacctgcggcactgatctccggccagccaatttacgatgactccatcccccgctcacggctttacgggcgctgggtcacccacgtctgggtatggatcgaaacgctctccctgcaactgaaagacagcatgtgcggttttcgcgtttatccggttgcgccaacgctgcaactggcaaaacacgccaccatcggcaagcggatggatttcgacaccgaagtgatggtgcgcctctactggcagggaaataccagctatttcgtgccgacccgcgtcacctatccactggacgggctttcgcattttgatgccctgaaagataacgtccgcatctcgctcatgcacacgcgtctgtttttcggcatgttgccgcgtattccttcactgctgatgcgccgctcttcctgccactgggcgcggcagagtgaagtgaaaggattatggggaatgcgcctgatgctgctggtctggcgtctgctgggaagaacggcgtttagcgcgctgctttacccggtggtgggcgtctactggctcactgcttctcgtgcgcgcaaagcgtcgcaagactggctcgcccgtgtacgacagcatcaaccacaggcggcaaaactcaacagctatcagcactttctacgtttcggtaatgccatgctcgacaaaatcgccagctggcgcggcgagctacaaccagggcgtgatgtgctgtttgcgccaggcgcagaagcagcgcttgacgtccgcgatccgcgcggcaaattgctgctggcctcgcatcttggcgatgtggaagtgtgccgggcgctggcaaaaattcagggctacaaaaccattaacgcgctggtgtttagcgaaaacgcccaacgctttaaacagataatgcaggagatggctcctcaggcaggcattaacctgatgccggtaacagatatcggcccagaaaccgccatcctgctgaaagagaagctggataacggcgaatgggtggcgattgtcggtgaccgcatcgccgtcaacccgcaacgcggcggcgactggcgcgtctgctggagttcgtttatgggccagcctgcgcctttcccacaggggccgtttattctcgcctctattttgcgctgcccggtgaatctgattttcgccctgcgccagcacggcaagctgcatattcactgcgaaagctttgccgacccactgcagctgccgcgcggcgaacgccaacaggcgctgcaaaacgctatcgatcattacgccgcgcgtctggaacattacgcgctccagtcgcctctcgactggtttaattttttcgatttctggcaactgccggaaattcaggacaaggagtaaagggtgctgaacgatccccgatttaccgcagaagtcgagctgaccattccctttcacgacgtcgatatgatgggcgtggcctggcacggtaactattttcgctactttgaagtggctcgcgaggcgctgctcaaccagttcaattacggctatcggcaaatgaaagagtccggttatttgtggccagtggtcgatgcgcgggtgaaatatcgccacgccctcacctttgagcaacgcatccgcgtgcgtgcgcatatcgaagagttcgaaaaccgtctgcggattggctatcagattttcgatgccgaaacgggcaaacgcgccaccaccggatacaccattcaggtcgcggtcgacgagcaaagtcgcgaactgtgctttgtcagccccgatattctgtttgaacgcatgggagtcaaaccatgaaatttttaccgctgctggcgctgctgattagcccgtttgtgagcgccctgaccctggacgatcttcagcaacgctttaccgaacaaccggtgatccgcgcccatttcgatcaaacccggacgattaaagatctgccgcagccgctgcgatctcagggccagatgttgatcgcccgcgaccaggggctgttgtgggatcaaacctcaccgttccccatgcaactattactggacgataaacgcatggtgcaggtgatcaacggtcagccgccgcaaatcatcacggcagaaaacaacccgcagatgttccagtttaaccacctgctgcgcgcgttgttccaggccgatcgcaaagtgctggaacaaaacttccgcgtcgaatttgctgacaaaggcgaaggccgctggacgctgcgcctgacgccgaccaccacgccgctggataaaattttcaacaccatcgatctcgccgggaaaacctatctggagagcattcaacttaatgataaacagggcgatcgcaccgatattgctcttacccaacatcaactgacgccagcgcaactgaccgatgacgaacgccaacgttttgccgcccagtaaacgccccgcgctgttatgggggctagtctgcctggtcatggcggtggcgttgctgatcctgctgccgcaatcacggctgaacagtagcgtgctggctatgttacccaaacagacgatgggcgatattcctccggcgctgaatgacggctttatgcagcgtcttgaccgccaactggtgtggctggtcagccccggtaaagaggctaatcctttggtcgctcaggagtggctgacgctgctgcaaaaatccgctgcgctcggcgacgttaaagggccaatggatgccgccagccagcaggcgtggggagcgtttttctggcagcatcgcaacggcctgattgaccccaacacccgcgcccgcctgcaaaacggcggcgaagcgcaggcacagtggatcctctcccagctttattccgcattctccggcgtaagcggcaaggagctgcaaaacgatccgctgatgttaatgcgcggctcgcagctggcaatggcgaaaaacggccagcgtttgcggctgatggacggttggctggtgacgcaggatccccagggcaactactggtatctgctgcacggcgaactggcgggatcgtcgtttgatatgcagcaaacccaccagctgatcacgaccctgaatacgctggaaaaggatctgaaaacgcgttacccgcaggcacagttgctctcgcgcggcacggtgttttacagcgattacgccagccaacaggcgaagcaggatatctccaccctgggcgtggctacgctgctgggggtgatattgctgattgtggcggtgttccgctctttacgcccgttgctgctttgcgtgatttccatcggcatcggcgcgctggcgggaacggtcgccactttattgattttcggtgaattacacctgatgacgctggtgatgagcatgagcgttatcggcatttccgctgactacacgctctattatctcaccgagcggatggttcacggcaacgacgtttcgccgtggcaaagcctggcgaaagtacgcaatgccttgctactggcgctgctcaccaccgtggcggcgtatctgattatgatgctcgcccccttccccggcattcgccagatggcgatttttgccgccgtcgggttgaacgcctcctgtctgaccgtcctgttctggcatccgtggctgtgccgtggcctgccggtgcgtccggttccggcgatggcgctgatgctacgctggctggcagcgtggcggcgtaataaaaaactgtcgctgggtctgcccgtcgcgctggcgctgttttcgctggcggggatgtcaatgctacgcgtcgatgacgatatctcgcagttacaggcgctaccgcagcatattctggcgcaggaaaaagccattaccgccctgaccgggcagagcgtcgatcaaaaatggtttgtggtttacggcgattcgccacagcaaacattgcggcgactggagaaatataccgcctcacttgagtatgcgaaaaaagaggggcttatcagcaactaccgcaccattccgctgaactcccttgcgcggcaggaggaagatttacaactgctgaaaacggcggccccgacagtaacaaaagcgctgcaaaatgccgggctgacggcagtgaacccggatctcaacgccatgccagtgaacgttgatgaatggctggcaagccccgccagtgaaggctggcgtctgctgtggctgacgctggaaaacggcgaaagcggcgtactggtgccggttgaaggggttaaaagtagcgcgttgatgcaggaaatcgccacatattacccttgcggcattgcctgggttgatcgcaaaagcacctttgatgaattgttcgcactttaccgctacgtcttaaccggcttgttgctggtggcgctggcagtgattgcctgcggcgcagtggcccgtctcggctggcgcaaagggcttatcagcctggtgccttcggtgctttcgctgggctgtggtctggcggtgctggcgatgagcgggcaggcggtgaatctcttttcgctgctggcgctggtgctggtgcttggcatcggtatcaactacacgctgtttttcagtaatccgcgcggtacaccgttaacttcgctactggcgatcgcgctggcaatgctcaccaccttgctgacgctgggtatgctggtattcagcgccacccaggccatcagcagttttggcattgtgctggtgagcggtattttcaccgccttcctgctttcgccgctggctatgcccgataaaaagagaacaaaaaaatgatcaaatccacattctggcgagcgttcgccctgaccgctacgcttatcctcaccggctgtagccactcgcaaccagaacaggaaggccgcccgcaggcgtggctgcaacctggcacgcgcatcacgctgccggcaccagggatttcacccgcagtcaattcgcagcaactgttgaccggcagcttcaacggcaaaacccagtcgctgttagtgatgcttaacgccgacgatcagaaaatcacccttgccgggctgtcgtcggtcggcattcgcctgtttctggtgacctacgatgcgcaagggctacgcgccgagcaatccatcgtcgtcccacagttaccgcccgcaagtcaggtactggctgacgtgatgctcagccactggccgattagcgcctggcaaccgcaacttcccgcaggatggacacttcgcgacaacggtgacaaacgcgagctgcgtaacgccagcggcaaactggtcacggaaatcacctatctgaatcgcaagggcaaacgcgtgccaatcagcattgagcagcatgtctttaaataccacatcaccattcaatacttaggtgactgatatgatttatatttccgccgtcggcatgatcaacgccctgggaaataaccttgacgaaatcgcaaccaacctgactcgcggtgttgctcccggcatgcgcccgcgcgcaggctggttgcaggggcatccgcaggcggtcctggctggcgtggatggcgagcttccgcttatcccggaaaaattcgctgcgcaccgctcgcgcaacaatcagatcctgctggcggcgctggcgcagatccagccgcaggttgatgacgccattgcgaaatatggccgcgagcgcattgcgattgtgcttggtaccagcacctccggcctgcatgaaggcgacacgcacgttaacctgcgcacccacgggcagccgagcaccacatggcactacgcgcaacaggaactcggcgatccgtcgcgttttctcagccactggctggcgctcgacggcccggcctataccctttcaaccgcctgctcttccagcgccagagcgataatcagcgggcgcaggcttatcgaagcggggctggtcgatgccgccattgtgggtggcgcagacaccctgagccggatgccgattaacggttttcacagcctcgaatcgctgtcgccaaccttatgtcagccgtttggtcgtgaccgcgcaggtatcaccattggtgaaggggcggggctaatgctgctgacccgggaaccgcagcccatcgcgttgctgggcgttggtgaatcgagcgacgcttaccatatttcagccccgcatccgcagggcgaaggagcgatccgcgctattaatcaggcgctgaccgatgcgcagcttacgccagatgacgtcggctatatcaacctgcacggcaccgccacacaactcaacgatcagattgaatcaatggtggttaacgccctgtttggcgaacgcgtaccgtgcagctccaccaaacatttgaccggacacacgctgggcacagcgggcattaccgaggcggcaattagtatgttgattttacagcgtgatttaccgctgcccgctcaggacttcagcctgtcgccgcgcgatcccacgctgccaccgtgtggcattatcgaaaaaccgcagccgctggcacgtccggtgatcctgtccaattccttcgcctttggcggcaataacgccagcattctgctcgggagggtttcgtgagccactatttatcccccggcgcttatctgccccacgacgcgcccatgttactgctggaagacgtggtgagcgtcagcgatgacagcgcggtgtgccgcgtgacggtttcgcccagtggcgtactggcaccgtttctcgacccggacggcaatctccccggctggtttacccttgaactgatggcgcaaaccgtcggcgtctggtctggctggcatcgccaccagcagggcaaaaacagtattgagttagggatgatactgggcgcgcgtgaattgctttgcaccactggcattctgcccgcaggccagacactgaccattaccgtcaaactgctgatgcaagacgatcgcttcggcagttttgagtgcagcatcaacgacggcgaggcgacgggccgcattaacaccttccagccgaccgcggaagaacttaccaccctgtttcaacaaggagcgtcctgatgagtcgttcagttctggttactggtgccagcaaaggcattggtcgcgccatcgcctgccaactggcggcagacggctttaacattggcgttcactatcaccgtgacgccacaggcgctcaggaaacgctgaatgccattgtcgccaatgggggtaacgggcgtttgctcagtttcgacgtcgcaaaccgcgaacagtgtcgggaagtgctggagcacgaaatcgcgcaacacggtgcctggtacggcgtggtcagtaacgccgggatcgcccgcgatgccgcttttccggctttaagcgatgacgactgggatgcggtgatccacaccaacctcgacagtttctacaacgtcattcagccgtgcattatgccgatgatcggcgcacgccagggtgggcgcatcatcacgctatcctcggtttccggcgtaatgggcaatcgcggccaggtgaattacagcgctgccaaagccggaattatcggcgcaacaaaagcgctggctatcgaactcgcgaagcgcaaaatcaccgtcaactgcatcgcgccggggcttattgataccgggatgatcgaaatggaagagagcgccctgaaagaggcaatgtcgatgatccccatgaaacgcatgggccaggcggaagaagttgccgggcttgccagctatttaatgtctgatattgcgggttacgtcacccgccaggttatttccatcaacggagggatgttatgacacgtcgcgtagtgattacaggaatgggcggcgtgactgcctttggtgaaaactggcaggacgtttctgcacgcttactggcatatgaaaatgcggtgcgcaaaatgccggagtggcaggtctacgatgggctgcacaccctgcttggcgcgcctgttgatgatttcacgctaccggagcactacacccgcaagcgtatccgtgcgatgggccgcgtgtcgcaaatgtcgacccgtgccagcgagctggcgttagagcaggcagggttgattggcgatccgatattaaccagcggcgaaacgggcattgcgtacggttcatcgaccggcagtaccggcccggtaagcgagttcgccaccatgctgacggaaaagcacaccaataacatcactggcaccacctatgtgcagatgatgccgcacaccaccgccgttaatactggcctctttttcggcctgcgcgggcgggtgatcccaacctccagcgcctgtacttccggcagccaggcaatcggttatgcgtgggaagccattcgccacggttatcaaacggtgatggttgctggtggtgccgaagagttatgtccttcagaagcagcggtatttgatacgcttttcgccaccagccagcacaatgatgcgccgaaaaccacaccttcaccgttcgatgaaaaccgcgacgggctggtgattggtgaaggcgcaggtacgctcattctcgaagaactggagcacgccaaagcgcgcggcgcgaccatttacggtgaaatcgtcggctttgcgactaactgcgacgcggcacatattacccagccgcagcgcgaaaccatgcagtattgtatggagcaatcgctgaaaatcgccgggttaagcgcacaagatatcggctatatttcagcgcatggtacggcgaccgatcgcggtgatatggcagaaagtctggcgacagcaaccatttacggtgataatgtgccgctctcctcgctgaaaagttattttggtcatacgcttggtgcctgtggcgcgctcgaagcctggatgagtctgcaaatgatgcgcgaaggttggtttgcgcctacgctaaacctgaataaaccagacccgaattgtggcgcgctggattacatcatgcatgaagcccgcaaggttgattgtgagtttttgcagagtaacaactttgcctttggcggcattaatacatccatcatc

SEQ ID NO: 192 - DNA  (genomic), 6563 bp; double-stranded, linear
acacctaccaacgcgccgttatttccttacggcgcagtaaacttctgacaaatatcgactcacgtcacatttttttgatcacgatttggtccctcaaaatgtgagacgcttcgatcctctttttctcccgttcacctactatacgcttgaagttgtccatgattgtccatagacaactgtaaatgttcaggtgcgcgccatgaaatcattaagtaagtcgtcacaaataccgctctatcaacaagtggtggagtggataagagaaagtatttataccggagatctggtggaagacgatcgcattccttcggaataccagattatggatatgctggacgtgagtcggggaaccgttaaaaaagcggtcgcccaactggtaaaagaaggcgtgttaatacaggtccagggtaagggaacatttgtcaaaaaagagaacgtggcatatccgttaggtgaaggattattgtcattcgcggaatcgctggaaagccagaaaatacattttaccactgaagttattacgtcacggattgaatcggctaatcgttatgtggcagagaaattaagaataacgcccggtcaggatattctttaccttgaacgcttacgctcaattggtgatgaaaaagcgatgctgatagagaaccgtatcaatattgagctatgccccggtattgctgaaatcgattttaatcaacacaatttatttccaacaatagaaagtttgtcgcaaagaaaaattcgttactcggaaagtcgctatgccgcgcgattaattggtaatgaacgtggtcattttttagatatcagtgaagacgcacccgttttgcatctggagcagttagtctttttctcccgaggattacccattgagtttggcaacgtctggttaaaaggaaataaatattatcttggcaccgtactgcaacggcgggaagtgagttaagtacacttttttaagaggaataaaatgcaaggcatacattttcaggaaaattatattcaacgacttccggcagggttaagcgttgaacagatcatccgccagttagcgcaaccgttggttgccgccgagctggtcgtccctgattttgccgatcacgtactgaaacgtgaggcgacgtacccaacggggctgcctaccgaaccaccgtgcgtcgctattccgcacacggaccataaacatgtcaggcacaatgcaattgccgtcggcatcctgccggaaccggtagagtttgccgatatgggcggcgatcctgaccccgtacctgtcagggtgatttttttgctcgccttaagcgaaagcaataaacaattaaatgccctgggctggattatggaaatgattcaggatacgccctttatgcaagccctgcttgcgatggaaacaacagaaatacacacagtaatcttaaacaaaatgaaagaacgaggtgaaatatgagtcaaaccattttatttgtctgcgccacgggtattgccacatccacggcggtaacagaaaaagtcatggaatattgcaaagagcaaggtcttaacgtcaattattcccaaaccaacgttgcctctttacctggaaatactgacggcgtagcactggtagtttcaacaactaaagtgccttatgaactcgacgtcccggtggtgaacggcttgccgattattaccggtattggcgaagaaaaagtactggcgcaaattgtttctatccttaaaaagtaattaataataattaatttcaacccactccatcaggcgctaacgcgaggtgcgctctcgcctgaaaaagaggtttattatgaacgatatcgcgcataccctctataatattgtgcaatatatattgggatttggcccgacggtaatgttgccgttggtgttatttattcttgctctctgttttaaagtaaaacccgctaaagccttacgttcgtcattaacagtcggcattggttttgtcggtatttatgccattttcgatattctgaccagcaatgtcgggccagcggcccaggcgatggttgaacgcaccggaattaatttaccggtggtagatttaggctggccgccgctttccgctattacatggggttcgccaattgccccgtttgttattcccctgaccattctgattaacgtggcgatgctggcgttaaataaaacccgtaccgttgacgtagatatgtggaactactggcattttgcccttgctggtacgttggtttattacagcaccggcagcctgttctttggtttgctggcggcggcgattgctgcggtggtagtacttaaactcgccgactggtctgcgccactggtacaaaaatactttggactggaagggatctcattgccgacgctctcttcggtggtgttcttcccggtcggtctgctggtcgacaaaatcatcgaccatatccctggcctcaatcgtattcatatcgacccggaaaccgtacagaaaaagtttggcatcttcggcgaaccgatgatggttggcactattctgggcattctgctcggcgtaattgccggatacgatttcaaaaaagtattgctgcttggcatcagcattggcggtgtgatgttcatcctgccacgcatggtacgcatcctgatggaaggtttattaccgctgtctgaagctattaaaaagtatctcaatgccaaataccctgaccgtgacgatctctatatcggcctggatatcgccgttgccgtaggtaatccggcgattatctccaccgccctgctgctaacgccaatctcggtctttatcgcgtttgtccttccgggtaatgaagtcctgccgcttggcgaccttgccaacctggcggtaatggcgtcgatgattgctttagccagccgtggcaatattttccgcaccgttctggcggcgatcccggtgattattgccgacctatggattgctaccaaaatcgcgccgtttattaccggaatggcgaaagacgttaacttcaaatttgccgaaggctccagcggccaggtttccagttttcttgatggcggtaacccgttccgcttctggctgctggaaatcttcaacggcaatctcatcgccattggtctggtgccggttatcgccctggtactgtatggcattttccgaatgacgcggagcacggtttatgcctgataacagcgcagctatcgttatcgatattggcaccaccaattgcaaagtcacctgcttttcctgcctggacgcaacgacgttgggcgcgcataaattcgtgacggcaaagcagatctccccacagggcgatgtcgatttcgatatcgacgccctctggcaggaggtccgccaggcgatagcgcaactgaacgccgcttcgccgctgccagtcagacggatcagcattgccagttttggcgaatcaggcgtgttccttgacgagcatggcgagatcctgacgccaatgctggcatggtatgaccgtcgcggtgaagagtatctggcaacgcttagcgaggcagacagtgcggcactttatgacatctgcggtctaccactacacagcaattactctgccttcaaaatgcgctggttgctggaacattacccgctgcgtaatcgccgcggcctgcgctggctacatgcgccggaagtgctgctctggcggctgactggcgaacagcacacggatatcaccttagccagccgcacgctgtgtctggacgtgcgcaaaggcgaatggtcagcgaaagcggcggcgttgttacacgttccctgtacggcatttgcgccattggtgcagccaggcgagcacgccggatgggtcagcgagtcactttgcaagacgcttgggttctcgcaaccggtcagcgtgacgctggccggacatgaccatatggtgggtgcgcgagcgttgcagatgatgccaggcgatatccttaactcgacggggaccacggaaggcattctgcaactggatacacaaccgacgctggatgaacaggccaaacgtgacaagctggcaaacggctgttactcacttgccaaccagttcaccctgtttgcgtcgctgcccgtgggcggtttcgcgctggagtggctgcgcaacacgttccggctaaccgatgaggagatcgccgcatcacttactcgcggacatgctgattatctggcggggaattggttgctcgatgacattcccgtctttattccacatcttcgcggttcgggttcgccctataaaaatcgccatacccgtggattattttatgggcttggcgatacgttaagtatcgacatgttaattgccagcgtatcactgggattaaccatggaatttgccaactgcttcgcctgttttaacgtgcctggcaccagcgcgttaaaagtgatcggtccggcaacccataatcctctttggctgcaattaaaggcggatattttacagcgtccggttgaagcaattgcatttaacgaggcggtttctgtcggagcattattaaccgccgcaccggatattccaccgccgccagtcgctatagcccaacgtttgttaccgaatcgggcgagataccatcaattacagcgttatcagcacaaatggaaaagctggtatcagttgaaattacaacaagaaggcgtgatgccattacatcatcgagaggaacactatgttgaataaaaccgtggaggtcagaaacagtactggcctgcatgcacgtccggcggcctgtctggcgaaagccgccaaaaaatatagctgtaaagtgacgctgcactatgagggtaatgatattaatgccaccagcatgatgaatattatgcgcgccggaataaaaggcggaaaaacggtggaaatacgctgcgacggtgatgatgaaaacgaggccatacagactctcaccgacttatttcgcgaccgcttcggtgaagctgaataattaactgatattaaaagatgaggttttcaatatgccattagttaatggacggatactgctcgaccgcattcaggaaaaacgggtattagcgggcgcatttaataccaccaatctggagacgacaatttcaattttaaacgctattgagcgttcgggattacccaacttcattcagattgcgccaaccaatgcacaactctcgggatacgattacatttatgaaatcgtgaaacgtcacgccgataaaatggatgttccggtcagtcttcatctggatcacgggaaaacccaggaggatgttaaacaggcggtgcgcgcgggctttacctcggtcatgattgacggtgccgcattctcttttgaagagaatatcgctttcacccaggaagctgtcgatttctgtaaatcctatggcgtaccggttgaagcggagctgggggcgattctcggcaaagaagatgatcacgtcagcgaagccgattgcaaaacggaaccggaaaaggtgaagacctttgtcgagcgtaccggttgcgacatgctggcagtttctattggcaacgttcatggcctggacgatataccgcgtatcgatatccccctgctgaagcgcattgccgaagtctgtccggtgccgttggttattcacggcggctccggtatcgccccggagatattacgcagctttgttaattatcgcgtcgctaaagtaaatatcgccagcgatctgcgcaaagcgtttatcaccgccgtcggcaaagcgtatgtgaataatcacaacgaggcgaatctggcacgagtcatggcatcagcaaaaaacgccgtcgaggaagatgtgtatagcaaaatcctgatgatgaatgaggggcatcggttggttagaaaggcatcttaagagccacaaaaatatagcggcgcaacagaaattgttgggccgctataagttataaatgattcaaacgctcattcagtgtttcaataatataggtattaacagagacttgttgctgcgcagccgcattattaaggcgttcactcagcgattctggatagcgtaacgtaaaggtcttaatcttttctgtacgcgcatacggctcaatacccgcagctttacaatcctcaagatactctcgcagggaaagttccccttctttttgcagcccctgaatgctgtcagagacaaaatcacaataacctgacaagcccaggaatttgccacgaaatgcattcagttctggcacgtaagtgataacagcaggttgcccggcaatctccatagagtttggcgtcttcagtttgatcatggttttacccctatacttagtaaccagtcacgcacgctttctacagcgcctttatcggtatctggcgacggatgaggccgatggaaacacgcaacgctcatatttagtatgagcttacaacgcgaacctcttccttccttaatttctccgcctaatgctttaaccagtgactctatatcagaccacttgatcccttgaggaacaggagttttaaatatttgatccaatgtatttttttgtttcttccgtaaagcctgtaccttggttctcatggcatgtccttatgacttcactttatgacatcaatagtatgacatcacagtatgaagtcaagtttcccttcct

SEQ ID NO: 193 - DNA  (genomic), 25 bp; double-stranded, linear
ttcaccaacatgtatagcaaactgt

SEQ ID NO: 194 - DNA  (genomic), 9057 bp; double-stranded, linear
gattgatcaatataaagaggcccagcaataaatagccagacctcccgttaattatacgttatgcagcaacgccttccggtatcagcgaagcaatttgcttacgccattgcgcttgctcctgttcgccttctgtacgttgaccataaagttgcgctatctgcgtaccatcatgggcaaacaattccagactggttacgtagccatcgctggtcggtttacgggtaacccaggcttcagcaatgctctcttctaatagatgaagagtaaacgtcgggttgaaaatattcagccaacctttcattggcaccactttttctaccacaccggtgaaaatctgtacgcagccacggttgccaacaaacaccatgatttcattaccatcctgctgtgcagattcaagaatttgcgccaacgcactgttggatactttgcaggccaaatcgtctgccaccagattgaacgcctgttggcgcgtcaggttgtggcgcttgagcaacgtaaaaaactgatgaacgtcggtcatcgcccgccactcttgctcgaccacagtggcatcggctcgcgtttgaacaactggcgcatcaacggcttttaactcaagcggcgtattctcatcggtgataaaccgtgccagaagctcactccatgccgccatatcggtattgtcggtggcataaacttttagtaatgcatcgccctgatgatcaaagaactgaatactctggcgttcgccacgagccgtgttttctttgatgtggaaaacactggcccattgattgagaaacagacgtaaatccagcgcgcgcggattgaggatcaatccggcatgtccgttcaaatgctggtttgtgaacgtaccaacttgctcatggactgcatattcattacgacaaatacatttggtttcgccaacactttcgagcgccgccagaatttcacggatatcgccgtgcatccgccacgcatcgtgcgtgacgcgtgcaaatgccagttctgcttctctaatattcattaaccctgcgatgtcacgcgcgtactttccgggattttgttcttttaactcaagccagcgtgtgtagtggttcattgtctctcttccttccagataaatgccccgaaatatcggggcagatgattaccattgataactcacgaaaatttttccgttacgaccatcctgtgggatgccttgcggcgaccagtactctttgtcgaaagcgttacccaacaccaaagtagtggtcatacctttgagcgcctgttgtccttgataactgacgtagaaatcattcacgccatagcctggttgtttgctgtaactgctgctgatatgtgttgagcgatcggcaaacgtaccaacccacccaacagagaagccactgtgagcgatcggaatattcagagtgctggtaacagtatccgggttaatgctggagatgtattcgccggtatcggtgtctttgccgcgggtacggttataggccacatcaaggctaaacagatcagtggtatatttcgtcatcacatcccagccccagattttggcgttcgggacgttatacgacatagtcgtcgccgccgcgaaatcgacggtcgtggagatgtaatccttcgctttggtatcaaagtagctggctttaaattccagagcatcattggacaacatcaggtcatcaaaacgcagcccaaaaccgtactcctgagtttcgttagtttccggacgtaagttcgggtttggcacccaatagttggtatagaagcgaccaatcgagaagtgcttagaatcgttatacatttcgcccatcgtcggggcgcggaatgcctgggcatatgagccaaataacatcagccagttagtcggattgatagtcatccccgcacgagatgaccatttgtcggcatcaacatctttgtaaccgtcactgctaccgcgataactgtcatagcgggttccgccaagcagggtaatcggcagatcgcgtaaggtgatctcatcctgtagccagccggagctaaaatcgatttttgcttgcgggaagcccgtcgtcgcgccgcccggatgttgttcctgacgataatactcaccgccatatgtcagtaagtgagaagcgaaactgtcggcaaagagagtggaacggttctccagcctggctccttttgttatctgttcacgatactcgccggaactccccgtgttttgcgcattaatacggacttccgaccaataaatttttgcatctgcatttaaccagtcgttgccctgcggggcgagtttataagaaagctgcgcatcgcgttgaattgttgaacgatcaaccatcgggttgctgctttcagaagccccaacggtctgcggattttttggttcacgcgcgtcgttgttgtagtaacgcactaaaccgctcagagactgggctgaatcaatttgccaggtccctttcgccagcatgttattaatggactcgtcattcggcgcggtttcaccattgctctggcgtaaatcaccccgatcgcgactggaccaggccacaataccatccagattttcagttcgcccaaacgcgctcgcgcctaatcccaggctatggtcccccgtgccgccagtaccaaagacacgaaaaccactgctttgtccttcctgcaataaatcttttgcatcgaccgtatcgtaggagatcactccacccagcgcgccactgccatacagtaatgctgaaggtccacgaacaatctcaacacgcttgatcagcgccggatcgagaaaagtgccattcaggtgtccggtatccgttccctgacgaacaccatcgacaagaaccagcacgccgcgatgatcatagccacgcatatttacatcctgaccgttggttcgtccggtaccatccagagtaattccaggaacatgacgcagcagatcggtggctgaagtagccgtttgattttcaggagcggaagtgtcgatgacgctgaccatcataggcgcttcgaaggaactacgggcattccccgttgccgtaacggtcatggtttcagtagcaaaagcaaacgttggcaaggtggcagaaacagctaaggccaataaactcaaacgcaacgaggtaaattgcggacgtgacatagcgattctccatgaggaaaataaaaaatgctggctgcctgggttaataccggggtggctggcgaaaaataaatttatttaaaattcagagcgataatattcgccgggtgagtttacaagcgtttatatcccatgaaattgcctgataactcggcaattacgcaaaagcacgccctctttgtcaggcaaaacgatatgccccatcaggagtgaagagagctgtgcgttatcccttgcaaatgctatggttttgttatccatatggtcgtgttttgttaaatgcaaacgtgataatgagaattattatcgatcaattttttatgatcaagtttttttttaaccaccattaacacaataaacagggggttatgaaacctatcctgcgccctgtaaaccaccttgtttttatggttatccccccatgcctcatcactaaattttgtcgttaacagtgataattttttcttctctttgctctgcaagcctcgatatctctgggttctcagctttttcccgcgatgaaatttagtcggaaacaagaacgttagctgacgaagcatcttgataaaaatcaaaaataaatacgcttgtaacgccttgcgtattgaatcgacggttgtatttcatatataactcaaatgataatcatgatcattctcaatttgataagagttctcatattatgccaaggatcatcaccaggccgtttcttttttccccactgacgttatgtatttcagccgtggcctctgccgcgaagaccgcagtaaaacgtaaaaaattgtttacggcagtactggctcttagctgggcttttagcgtaacggctgccgaacgtatcgtggtcgcaggaggatcgctgacggagctaatctacgcgatgggcgctggcgaacgcgtggttggtgtcgatgaaacgacatcttatccaccagaaaccgccaaactgccgcatattggctactggaaacaactcagcagcgaaggcattttgtcacttcgcccggatagcgtaattacctggcaggatgccgggccacaaattgtgctcgaccaactacgagcgcagaaagtcaacgtcgtcaccctgccgcgtgtgcctgccacccttcagcagatgtacgccaacattcgccaactggcaaaaacgctacaggttcctgaacaaggcgaggcgctggtgacacaaatcagccaacgcctggagcgagtacagcaaaacgtggcgaccaaaaaagccccggttaaagccatgtttattctctccgcaggcggaagtgcgccacaagttgccggtaaaggcagcgtcgcggacgccattctttcgcttgccggagcagaaaacgtcgctacccaccagcagtacaaaagctacagtgcagaatcactgattgcggctaatccagaagtgattgtcgtaacctcacaaatggtcgatggcgatattaatcggctacgttctattgctggaattacccacactgccgcatggaaaaaccagcgcattatcaccgttgatcaaaacctgattctgggaatgggtccgcgtattgctgatgtcgttgagtctttacaccagcagctttggccgcaataaatggatttaaatcagacgaatgaacgcaaataacaccctggatctcacgccacattttgctttagacggtgatcagccatttaaagacaggcgcgccatgatgccgtttcgtggagccattccggttgccaaagagcaactggcacagacctggcaagagatgatcaatcaaacggcatcacctcgtaagcgactggtttacctacacattcctttttgtgcgacacactgcacgttttgtggtttttatcagaaccgttttaatgaagatgcgtgtgctcattataccgacgccctgattcgtgaaatagaaatggaagcggacagcgtattgcatcagtctgcccccatccacgcggtctatttcggtggcggtacgccttccgcactttcggcacacgatttggccagaatcatcaccacattacgagaaaagctgccactggcccctgattgtgaaatcactatcgaaggacgggtattgaattttgacgctgagcgaatcgatgcttgccttgatgcaggagcaaaccgcttctcaattggtatccagtcgtttaacagcaaaatccgcaagaaaatggcccgcacctcggatggcccaaccgctattgcgtttatggaaagcctggtcaaacgtgaccgtgctgcggtggtctgtgacctgctgtttggcctgccgggtcaggatgcgcaaacctggggagaagatctggctattgcccgcgatatcggtctcgacggcgtcgatctctatgcgctcaatgtcctgtccaatacaccgctgggcaaggccgtggaaaatgggcgtactaccgtaccctcaccggcagaacgtcgcgatctttatctgcaaggatgtgattttatggacgatgccggttggcgctgcatcagtaacagccactggggccgtaccacacgcgaacgcaatctctataacctgctgattaaacaaggtgccgattgtctggcctttggttccggagccggcggttcgattaatggttactcctggatgaacgaacgcaatcttcagacctggcatgaatccgtcgcggcaggcaaaaaaccgctgatgttgatcatgcgtaacgccgaacgtaatgcgcaatggcgtcataccttgcagtcaggtgttgaaacagcgcgcgtaccgctggatgaacttacgccacatgccgaaaaactcgcgccgttactggctcaatggcaccaaaaaggcttaagtcgcgatgcttcaacttgcctgcggctgactaatgaaggtcgtttctgggcaagcaatattttgcagtctcttaatgaactaattcaggtacttaatgcgccagcgattatgcgtgaaaaaccataacaggagtgatttatgagccatgtctcgttacaagaatttttgaaaacggagccggacggtacgctggaggtggtagccgaacaatacaacaccacactgctggaggtagtgagaaatctaccctcctctaccgtagtgccaggcgataaattcgatactgtctgggataccgtctgcgaatggggcaacgtcaccacgttagtacatactgccgatgtaatcctcgaatttagcggcgaactgccttcgggtttccatcgccacggctatttcaacctacgcggaaagcacggcatgtccgggcatatcaaagcagaaaactgcacgcatattgccttaatcgaacgtaaatttatgggcatggacaccgcgtccattctctttttcaacaaagaaggcagcgccatgctgaaaatcttcctcggcagggatgaccatcgtcagctcctgagcgaacaagtcagcgccttccatactctggcggcatcgttaaaggaacacgcctgatgacgccgtggctactctttggcgcaggcggaaaaggtgtgggtgccagaacgcttgaactggcgctggcggaacaacgtccggtcgttgctgtcattcgtcatgccgatgccgccacgaaactggcgcaacaaggcgtacaggtttttacaggcgacgcctgtgatgccagcgtagtcgcggctgcttgccgcgcagctggcccggatgcgcttatcatctcaacaatgggaggagctcaggattatctggcgcacagaacagtgattgatgaggccgaaaaggccggcatcagtcgcatgattctggtgacctctttgggatgcggcgatagctggccgtttttatcggagcgggcaaaggctgcgtttggtcaggcggtacgggaaaaaacgctggcggaaagctggctgcaaaccagccagctagactacgccattctccgccctggtggtctgcttgacggcgcagcaacaggcaaagcacaacggatacaaaatcaggagtgtcatggttttgtccgccgtgccgatgtcgccgcacatatccatgaactggcaaatgcgccagcacttaaccagcaggtctacagtctgattgaaccggacctgaaaccggcgtgataccccggcgcggcatgtccgcgccgtaatgtcgtaacggagttttgcgtgctcaaggattcattttcatccgccagggtctttatgggactatcactattattgcttgccctggtgctgttcggtgctagtcagggagcgttaaagatcagttttgatgccctttttgatgaggaataccgcgatatctggctcaatattcgtctaccacgggttttgctggcggtgctggtaggtgcagcgttggcaaccgcaggggtaattatgcaggggctttttcgcaacccaatggctgacccaggattactcggcgtcagtagcggttctgcattaatggttggcgttgcaattgtgctgcccttctccttcccagtggtgctggtgctctatgagcaaatggtgtttgccattgccggaagtttagtagtctgcgccatcatttttctcatcacgcagcgccatcgcgatggcagcatgatgcaattattactcgccggtatcgccatcaatgccctgtgcggcgcagcgatcggcatcctgagctatattggcgatgagcagcagctacgacaactcacattgtggatgatgggcaatcttggacaggcgcaatggccgacgttattggttgccagttcattcatccttccggccattatcgcaacaacttgtctcgccggaacgctgaatttactgcagctcggtgatgaagaagcccattacctcggcgtgaacgttaagcgtaaacgccagcaattactattagtgagctcactgctcgttggtgctgccgtatcggtaagcggcattatcggctttattggcctggtgatcccgcatctgattcgcatgactaccggagcaaatcaccgctggctcatcccttgttccgccctcgccggagcctgtttattgctgatggcagacacgcttgcccgcacgctggtacagccagcagaaatgcccgtgggattattaaccagcctgcttggtggcccttattttatgtggttgattctgcgaaatcggaggatcacatgatcagcgcccagaatcwggtttatagccttcaggggcggcgtctgactgataatgtctcgctgacttttcccggtggggaaattgttgccattctcggccctaatggtgcgggaaaatctacgctgcttcgccagttaaccggctatcttcaacctgatagcggcgaatgtcggttgtttaataagccattaaatgaatggtcgattactgaactggcgaaacaccgggccgtgatgcgtcaaaatagccacatggcgtttccattcagcgtacaagaagttatccagatgggtcggcatccgcatcgtactggtaatcaggataatgaaacagcacaaataatggcgttatgtgactgtcaggcgttagcaaaccgcgactatcggcaattatccggtggtgaacaacagcgcgtgcaattagcgcgcctgctggtgcaactctgggaaccaactccctcaccgaaatggttatttcttgatgaaccaacttcggcgctggatattcaccatcagcagcacttgtttcgtttattacgccagttagttcacgagcggcagttcaatgtctgctgcatattgcacgatctaaatcttgccgcgcattatgcagaccgtgttgtattaatgcaaaaaggaaaggttatcgcaaatggtaaaccacaggacgtattgacacagcaggcgctgacaatgctctacggcgcggatattaccgtacttaaagatcctgccaaccattcaccactgatcgtcctcgatcattaaaagcaacaggagtaccgcactggtactcctgcgaataaataactata

SEQ ID NO: 195 - DNA  (genomic), 5903 bp; double-stranded, linear
cggaatagaccattttaacggattaacgactattcagagataggttgggccaggatgctggcccagtaacttactcataggtgatggaaaaatttacaagggcattcgctgtgccaccagtggcctgagtgttgacgaccacataactcgcctggtagtgaagcgacgtggtttcgccatcaatcgcccattcaatcggcgttccgctggagcctttgggaacttgctgcgttcctttatcgtcctctatcttcaacgcaacacccgttgcgccaccagcctcaagggcaaacatggaatcatcatcgctgtccgactgactgtccatctcaacggtcgctttggatatcccatcgcactctttgagttcaatggtgaaatctttcttgctcaacaccgtaccgactgccgcaggtttttgcagcgtcattgttcccatatcgacttcgagatcgcttttttccatctcgcaagctttagtggtgatagtgatggagaaatgaatatcccctgccgggccaagatccgtcgccgcattcaccccgcaggcaaccagactcaaactggcgatgccgctatgcagcaatcgtttgaacttcatggcatcactccatttcaagatatatggtcgttacgccttcaaacgtcccgcctttaggcgctttacccgtcgtgctaatcggtaaagccagcagtcgaatcgcggcattgcggtgagttttagaatccaggctgctcaaatttaataacgtggtgctgcttgaatcattcggtaccaaaattttgccgctggaatctttcaccagtacgccaatatcggggttgcccatatccaccgctcggggatcgtcagcattggttgccccctcaaggcgcaacgcaaccttgataccatcagagatattgttgcaatcgaagctgaggttaatttcttgctctgtcgcaccttcaggcatttgcccttgcctgtttttaaacgccgaggaggggaattcaccaaatggcacatccagcaccgtgccgggtttaatttcgcaatcctgggttacggtgacacgcccctgaatagatacggaagatatgggtattgttccgtaatctttatttgttttcgaggcatacagttcggcaattaacgtcagagggatgacggaatcgccgataaagggtttagtaatagcaaaggaaagtagacctgcgccgcccatatagggcgtagtaatgactttgttgcatccggttgtttgcagcgcctgctggtttttgaaaggaacaaacccatacacactggtactgatgcgaatgttcgtcgcaacctccagttcctccgtcaaagtataatatttcatactgtcaaccgtacggccagaagggggaagcatactcaccccctgcactagagtatctttttcattcttataagaatcaggacattcacaaattagcgatacgttttgtccattagaccagttaaggacatccggtaaaaccgttcctgcgacgttttttgccgcatcaggtataccaacatccacatcgacattatagtgataagtcgtgccatccgcgggggtacatggcccccacgcatctccggcaaatgccttgccagaaaatccgaatacgcatcctaataaggataatgctattgccgctttcatttcgctctccttgcttactggcaattggccgaaacaggaataattccgccctgttttaattccagggataatttataaggcgccacgcattgctgcgacgcgtcattaccccatttaatcaatacccgtccttcctctggcattccgctaatatagagctgtccttcttcaccaacgatactgctcacctcgttttgtttatcggtgattagcgttgccgttgctccaaagggcaccgggctgcccgcggaacgaagcagcgtcattaatacgcggtaaccaacgcgggtatcaaaacgcgctctgacaatcgctccacgcgttggcaccactttctggaacgcattttcaacgtcaacatcgtcacccaacgaatcgctacgcagtgagatttcgttttcacgatacggcatggcataaggcacgatcgcgttacccatccagtcaacctgaacgccgccgttattcaccacgcgggcattgcgcgcaccgggtacggagatgagcgtcatggtttcgcctagcggttgggaaagcgtcacgccttcgctatgaactatcacgccgccgcgaacgctgtagttgagctgccggtaatctttcccgtagctatagcctacgttgacattaccggacccaccctgatagccaacgttagcgttaccgctgttacccacaccgttgctggcgtagccttcctggacactgtagctcaggttgcgatcctcaagcagcgttccgctgaccccaacctgttgattggtacgaccatcctggtcggtcgtgacgcgatagttactccaggcccggcctagtggaacggaaatattgaaagaccacaagcgatcgctttcatcccattcagggcttttattccagctatatgcaatactgtaactgaccttgccaatacgtccgttgtaacccgccgataccgtgttctgtttacctgcgtcgttccagtaatcctgctgcgttaaatttaaataaacagagccataggcccctaattgctgcgtcaggttaccctgtatttcgctgcgcttgtgataacggttatagtcgctgtcagcgtcactgcgcacatcggtggcttcctggaaggtatagaaaccgctggtagagtaccgatagcccgcaaggcggaaatcggtgccgctttcgaagctcttggaatataagaaacgataagattgtccctggctatcgcgatcgttattcagttcgcttttagcctgcgtcacatcaatggaaatcgccccgatataaccaaagtttttccctatccctaatgtaaatgcattgtaattattagagattaatacgccgccgtaggccgtcatcccccacggtaaaccgtagatcagatcaagctgcccgaaacgcggcgaggcgctgtcataattcccggcctgatattcacctgcggcaaagctatatttgagatggccttcacgctggaaaattggcaccgatgagaatggctaaataaagcgttgttcactgccatccgcttctttaataatgaccgtgagatcaccgctgtttgcagtggggtaaagatcgtttatttcaaaggcaccaggctgcacataggtgcgataaataacgtagccgttttgttcaatactgacttcggcgttgcttttggcgatccctcgaacgatgggtgcaaagcctcgctggctgtcgggcagcatctcttcatcagaggctaacatcgcgccacgcatctgaacgctgtcaaaaatgtcccccgcggtcgccgtatcccccattgttaattgcgctttgaaagggatgatggccctactcaaagacgtaccgatattatcccactgcgctttgccaccggaatggctccaggtactgtaattccgtaaccgccaagcgccaaggttcagcccgctgcgtaagttgaggtagtagctgtcgctctttagcgtatctttaccatcatcatgatgaacagtgccattatcatcgacataactgctggaagaccccgtcgagtcatattcactgttgctcccgctaaaactgtaatccagcagcaacgcagggataccttcgtcccataaagattccggcaccgtgccgcgcgccacctggtgcatcgccgcctgagggaaacttaataccagcttttgttcactgaagtcgaaatggcttgaggccaggggaatgatttcgtcaaacggtacgcaggcttcggcagacaccagattgagggccggaaagctttcaacgcgcacgcccatctctgccagttgcgtccggctaaggcaaggcacaagggattcccccatcgctttgcgctgtgcttctgtggcctctttaaattccagtgtgcgggtttccattctctgttcattgacgtaaacagagacacgatagatgccgggtaactgctgttcctggcctttttcgaacatcgttaaatcgacatgctggcccacaccctgaacgtcctccaggaatttggggttaaactttccggcatgtgcagaaaacgtgctggcaacagcaaccgccaccacagagatagaaaaggaagaaaaagtacgtgaaacggtcttccgtgacattgagctatttctcctgaaaagatattaatcaatcaacatttttagtgatcatttccgctgacgatccaaagtcattgatggtgttatatttaattttagaaacgctacctaccccggcgggtaatgtgatatttaatgcccctttagcgggtaccatgcctgctttttcaatttctttgtcattcgcaaaaaattgattaaaggtaatattaaaaactgtcggattatcaacgcggagctgattaccgttacgcgtaaatcgcagttcatttggcgcggtttttacatcaccctttaaacctgccgggcgataaaaaagtttgattcgggtgcgaacggcaatctgcaaaacatttttgttttcgctgtcgtcacttttagatggaatggctttcacattaacccagtagaccgattcgcgatcctgaggcaggccgggcgtaatattcacaatacgcaaaatattgttcttttctggatcaagcttgaatagtgggggcgtaataataaacggtgtttttttgctgcccgcggcatcatccacccaggattggataagaaactcttccgtcttacttttattctgtacggtcagcgaggcttctttcttactgccatcataaattacgcgagtagagctaagtccgacgccacccgccagaactgactgtgaaaggaacagagagagagccaacgcaacaaatttacttttcatcattcgatccatgaactttgacgactaatggcggcaattacgccgccatttgtaaaacggacgattactcgtaagacaggttgaaatcgacctgcgcattgccgtaaccggtcgttaccgttgccagagtagaaacgtagttagcggtaaagtagagaaccgtctggcctttactcagatcaacacttgctttaccaccgttaagagcgaccagggtattgctgttatcataaataccgataccaacacctttggccgcgcccgcttcagtgctaacagaaatcagatcagatttatctgcatcaccaacaccactaaagctcacattggcttttttcatcgtggtggtatcgcaatcttccagtttgatttcgaaaggttttgccggggatttgtcaccaaccgcagcaaatacagatttttgtacctgacccaacacaacttcctggttctgagagtcaacggacagtacgcaaggtgaatccacgatctcgcctgtaaatttaaccgtgccgtcaccagactctgctgcgaatacagtgccagaagttaacgccagtgcggttaaggcaaaaacgacctttttcatgaaaaactccatttaaaaaattacattaaaaagaaaatcttgatgtattaaaatcgacaactttgaaggaaggattatacaatgaaatacgaataataaaattatacgaataatatattaatagcgcatccaatttcaaatcttaaaaaaatcattgcattacattttcacataaaaagctatcgtttatttttaggaataaataaatataaaataccaattaaacaaaacaaaaacattcaccacgcaaataataagataaaatattttcatttttattctttaaaatgcaataaaaaaggaggatttcctccccctttcgttcaaaacctgtagtttctggctaaata

SEQ ID NO: 196 - DNA  (genomic), 39 bp; double-stranded, linear
gaggctaaccttatggtgtctatacatagaggggcctca

SEQ ID NO: 197 - DNA  (genomic), 4021 bp; double-stranded, linear
gcacaacgccgccacttccgtgagcgatcgcgcttcgctaattaacagcttttcggcttcgcgcacccgctggcgatggattgcttctgttaacgtcagatgaaacacccgccggtagacgcgcccaagataatcggcattgcagtacagctcgcgggccagaagcgccgtagaaagcgggcgatgatattgcgtgcggatcagtttctgcgctttccaggcaagggtggtgcctgcgccatcggcctgttcatcaagacgcgcgtcacgggtgagctgctgcaaaatgagcagcacaataaactccagcgccggagtgcgttgatgcttttcctgttcgcttaagaactggcgaaacagggccaccagcgcctgcggatcgacaaccttcgtttgttgcggcacgctaagatgagtaagccagcgagggtcgttgtccggcgctttaacctcaaaatgcagccagtaaaatttgagatcggcgggaaaatcctccaccccaacatgttgtcggttcggccagagtaataaactctctcccgcatcgaccagaaatatccgttcttcttcctgaatcgttaatcgacctttttcgacaaagataatttcccatgactccagccgccttgcagaatgcctccctacgccacgggaaataaataatccaccattttgcactttaatcggtaacgtcatggataattcgagcattgatatgtaatttcccgcttattcattaatgattaaacacattaccttttgattattaatcaaaaacattaatttcacctgatccatttcacacttttaaattcaggtcggaatcgtcacctttttttactcttttctcgccttgttgatattcccgttcacggcagaattaatcaggtcatttcaataaaactaaaaattgctccctattcacgaggaatatctatgacctctacaccgattactaccgctgatatcgctaaaggtaaaattgacgatgcgttatctgtacgggaaaaaataggctacggcctgggtgacgcaggcggcaccgtaataacttgcctgatcatgaattttctcacctttttctacaccgacgtttttggattaactccggcgctggttggcacgctgtttattgcactgcgcgtgtttgatgccatctccgacccggtgatgggcgtcattgccgaccggacgcaaagccgatgggggcgctttcgtccgtggcagctatggattgccattcccatcggcattatcggcatcctgacgttcaccgtgccagatgccagcatgggagtaaaaatcgcctgggcgttcggtacttacctgctcctttcagtcggttataccgccatcaacgtaccgtactgcgcgcggatcaacaccatgaccacccgccacaatgaagtgatctcctgccagtcctggcgattcgttctctgcggcgtagcgggatttctggtttcggtaggcttaccgtggatggtagctctcttcggtcagggcaacgctgcacgcggctatcaactgggcgtcggggtattgtgcgccattgccgtggtgatgttcctgtgctgtttcttctgggttcgtgaacgggtgccgctctccacaatggggaaatttaccctgcgcgaacatcttgccgggctgcggaacaacgaccaactgctgctgatgctggtcatgtctttcctgctgattaacgtctttaacattcgcggcggtgggtatatgtacttcattacctacgtcttacaaggcagcacgggctacacgtcgctgttcttcaccatggtcaccttcgcctccattatcggctcggtgattgtcagcccgttaacgcggcgtttcgataccgtcaaaatttattactacaccaacctgctcctcgctgcactggcggtgttgatgtggttcctgccctccggcccggcttatcaaacgctgtggctggcggtgatcctcggtaatggcgtgattcttggcttcacattgccactgcacttctcattgatggcctttgccgatgactacggcgagtggaaaacccacgtacgttcttccggcatgaacttcgccttcaatctgtttttcatcaagctggcctgggcctccagcgccgggatcatcagcctgctgtttatttttgtcgcctaccagcctggcgtggaaaaccagaccgccagttcgcttggcgggatcgcggcgatggaaacattactgcctgcgctattccacctgctgctggcaggggcgatccgcttttgcaaactcaataatcctatgatgtcacgcatagctaccgacctgcgtcagcgtcatgtacagccttaaggagcacaagatgaacatttcggaagtcgatctgcataaactgacggtcagcgatccgttcctcggtcagtaccaacaactggtccgcgacgtggtgattccttatcagtgggatgccttgaacgatcgtatcccagaagcggaacccagccatgcgattgaaaactttcgcattgccgccggacttcaggagggtgaattttacgggatggtgtttcaggacagcgacgtcgccaaatggctggaagcggtagcctggtcgctgtgccagaagccggacgccgaactggaaaaaaccgccgacgaggtaatcgaactgatcgcctccgcccaatgcgaagacggctatctcaatacttactttacggtaaaagcacccgaagaacgctggagcaatctggcggagtgtcatgaactttactgcgcaggtcatctgattgaagccggagtcgccttcttccaggccacgggaaaacggcgcttgctgggggtcgtttgccgcctggccgatcatatcgacagcgtatttggtccagatgaaagtaagttacacggttatcctggtcacccggaaattgaactggcactaatgcgcctgtatgaagtgactgaagagccgcgctacctggcgctgacgaactattttgtcgaacagcgtggtgcgcaaccgcactattacgaccaggaatatgaaaagcgcgggcagacatcgcactggcacacctacggcccggcgtggatggtgaaagacaaagcctacagccaggcacatttgccccttgcgcaacagcaaaccgccatcggtcacgcggtacgttttgtctatctgatgaccggcgtcgcgcatctcgcgcgtttaagtcacgatgacagcaagcgtcaggactgcctgcggctgtggaacaatatggcccagcgtcagttatatattaccggcggcatcggctcacaaagcagcggcgaagcgttcagcagcgattacgatctgccgaatgacacggtttacgccgaaagttgtgcttccatcggcctgatgatgttcgcccgacgaatgctggaaatggaaggcgacagtcaatatgccgatgtgatggagcgcgcactgtacaacactgtgctcggcggcatggcattggatggcaaacatttcttctatgtgaatccactggaagtacatccaaaatcgctgaaattcaaccatatctacgatcacgttaaaccgatccgccagcgttggtttggctgcgcttgttgtccgccaaatatcgcccgcgtgctgacctcgattggtcattatctctacacgccgcgtgaagatgcgttgtatatcaacatctacgcaggaaacagcatggaagtgccggtagaaaatggcacgctgcgcctgcgggttagcgggaactatccgtggcaggagcaggtgacgattgcggttgaatcgccccagccggtacgtcatacgctggctttacgtctgccggactggtgcacacagccgcagatcatattgaatggggaagaggtcgagcaggatattcgtaaagggtatttgcacattacccgcgaatggcaggagggcgatacgctgaatctgactttgccgatgccggtacgccgcgtttacggtaacccgctggtgcgtcacgtcgccggaaaagtggcgattcagcgcggcccgctggtg

SEQ ID NO: 198 - DNA  (genomic), 217 bp; double-stranded, linear
ccagccaaacgccagacgcaaactctgacctttatcccgtggtttagctgggccaaccggggtgaaggcgaaatgcggatctgggtgaatgaggaaaagcattgccatccgtaggttggataaggcactcgcgccgcatccaacgtaaggagcacattgcctgatgcgacgcttaacacgtcttatcaggcatacaagtcggtgcgagagcgtaggc

SEQ ID NO: 199 - DNA  (genomic), 1368 bp; double-stranded, linear
ggataatgcgcgaagtacacggcttgctggtcattaattttcttctcttgcgcaaacccttctttaacaattgtccgtaaatcagctcgaaccgtattatcagagacgcccaggctcgcgctaatttcagcaactgtgtactctttccccggattggcgagcatcacattcaggagcgttacctggcgcggattcaggcgtttaagcacaccagagctaaacagcacactatcgagttttgcgcttcgttgtgtaatttcatcgatatgctgctgccagttttgcagagcacgtttaatgacacccgcctgatattcaaggaaataagtcagatccataccatctgattcagtgtactggtagctggcggcatatttgaccggtgcagcatgaagcaaacggctgatggaaatatatttaaagacatcgtagcccgatttcagcatataccagtaaaacagcgcccgactggtgcgcccgttgccatcccgaaacggatgttcatgggccagcataaaatgcagaatgcaggcacggaccaacggatgaatatacccttcatggctgtttaaccactggcaaactttttccagccgttccggtaacaatgccgcagcgggcggttgatgcactatattgccatcatagtcggcgatcacaacatcatctgtttcacgaaattctcccggacgatatttcgcgtcattgattccacccataccaatggcatgtaactggcgaataagcgcaggtgtcagcggttctgcgagtaagtgcggaatttccgccatcagccgggcatttcccgcaatcatatgctcgtcttcagtgcgtggcgaccgtcctgtttccagcatttttctcgccaccagcgttgtagtattcgcaccttccagctgggagctggtgatcggctcttccaggcgtaactggcttaactcggctccggccccgcgtaaccgttcagtctgatctttcagcgccagcgcggtagcacgtttgtcgacaagctcgcacgcttctgcaatcaccggggtaatgttgaatccggcctgttcacccgcttcattgcaataattaattcgttggatcgccgcgttgcgcgccagacgggtaagcgtccacgccacatcgacgttttctccttttttgatgcggtactgcaactcatcaaaaggcagataacgtcctttttcatcggtaacccggttaaagcgcaggtgggcctggagttcctcacccgataagtgtgataaaggaatcagcgtgggaggtgatttgatagccatttgcttatctcaaaaaagcgcaatattgagatagtgtatagcaggaaagagaaactatctcaaaaaaagcaagttttga

SEQ ID NO: 200 - DNA  (genomic), 6091 bp; double-stranded, linear
gcctcagacgactggttcgatcatatcaacccgcatctggcttgccttagctggtcaatgcggggactctcctgtctactcgcctaattaccaaacaattcactccctttacgtcgatttaccgctggttgatattctgaaaatgcatttttaccgaaatagccacctataaacaataaaaatatatagaagatatcatttattaattaacaagcagttacgtctctttttttcggatttaattgtgaaattttaatcatcatattcatacaataaattatctgtaaattttttcccagacatggtttctttcatatttgacatttattaataatcatcattagaatccacgaaaataatatattcatacaaacacagacatcttttgaaacgaatgatacatttttataatgaatgcttaaaacaatatttaatcgacacacatcactgtcattaatgtaaagcaacatagatcaccaataatacaatggacaactctaccggcattgatcgctgggcggaggaaataaggatttttacatgaactagaagaagatttttttcagtgctgtcactgtttcagttctctgcgcattaacgggatgtgactacattgaagaaggcaagccagaaagtagtttattgaaacaacaagaagaacataacaataaaattgatctacttgaaaaacaacaagcacagctaaagagtcaactggaaactattcaaaaacaacaaactggcataataagcagtacaaagactttaactcacgtaattaaatccgttaaagatcaacaaaacacttttatttttaccgagtttaacccagcaaaaacgaagtatttcatcctgaacaatggttcggtggctttagcgggtcgagtgttatccattgacgccacagagaatggcagtgttattcatatttcactggtcaacttattaagtacacctatctcaaatattggttttaatgcgacatggggtggtgaaaaacctgtcgatgccaaagagtttgcccggtggcaacaattacttttcaacacatcaatgaaatccacattgaaattattaccaggtcaatggcaagacattaatttgaccctgaagggtgtatcgcccaataacctgggatatctgaagttagccatcaacatggaaaatattcagttcgacaatcttccctctgctgaaaatcggcagaaaagaagcaaaaaataaatgcagttagtacgcttataacaaggaatagcgagcatcattaatgaacaaaatatttaaagttatctggaaccctgcgacagggaattatactgttaccagcgaaacggcaaaaagccgtggcaagaaatctgggcgcagtaagctgttaatttctgcgctggttgcgggtggaatgttgtcgtcgtttggggcattggcgaatgccgggaatgacaacggtcagggtgttgattacggtagtggatcagctggcgacggctgggttgctataggcaaaggggcgaaagcaaatacttttatgaacaccagtggttccagtactgctgtgggttatgacgctatagctgaaggccaatatagctctgccatcgggtcaaaaacccatgcgattggtggtgcatcaatggcctttggggttagtgcaatatcagaaggcgatagaagtatagcactgggtgcctcttcgtattcattgggccaatactcaatggccctcggccgttattcaaaagcattgggtaaattgtctattgctatgggggactcttccaaagcggaaggagcaaacgccattgccctgggaaatgccactaaagctactgagattatgagtattgctcttggcgacaccgccaatgcgtcaaaagcgtattcaatggcgctgggagcaagtagcgtcgcatctgaagaaaacgctattgcgataggtgctgagaccgaagccgctgaaaatgcaactgctattggcaataatgcgaaggcaaaagggactaatagcatggcaatggggttcggaagccttgccgataaagtcaatactatcgcattaggaaatggcagccaggctctggcagataatgcaatcgccataggccagggcaacaaagctgatggcgtggatgccatcgctctgggtaatggtagccagtcgagaggcttaaacaccattgccttaggcacagccagtaatgcaactggtgataagagtcttgcgcttggtagtaatagcagtgccaacggtattaactctgtcgcgctgggcgcagattccattgcggatttagacaataccgtctctgtcggcaatagttcattaaaacgcaagatcgttaatgtgaaaaatggcgcgatcaagtctgacagttacgatgccattaatggttcacagctttatgccattagcgactcggtagcaaaaaggcttggaggaggggctgcagtagatgttgatgacggtactgttacagcaccaacctacaatttaaaaaatggtagcaaaaataacgtaggggctgcgctcgctgtacttgatgaaaacaccctgcaatgggaccaaaccaaaggcaaatacagcgctgctcatggtactagtagcccaactgccagcgtaatcaccgatgttgcggatggcacgatttcagcctccagtaaggatgcggttaacggttcccaactgaaagctaccaatgacgatgtcgaagccaacaccgccaatatcgctactaataccagcaacattgccacgaatacggcaaatattgccaccaataccaccaatatcaccaacctgacggattccgttggtgaccttcaggctgatgccctgctctggaacgaaactaaaaaggcattcagtgcagctcacggccaggataccaccagcaaaatcaccaacgttaaagatgccgacctgacggctgacagcactgatgctgttaacggctctcagctgaaaaccaccaacgatgctgtggcgacgaataccaccaatatcgccaataacacttccaatattgccactaacaccaccaacatctctaacctgactgagacggtgactaatcttggtgaggatgcgctgaaatgggataaggacaatggtgtattcacggcagctcatggcaccgagaccaccagcaaaatcaccaacgttaaagatggcgacctgacgactggcagcaccgatgccgttaacggctctcagctgaaaaccaccaacgatgccgtggcgacgaataccaccaatatcgccactaacaccaccaacatctctaatctgactgagacggtgactaatcttggtgaggatgcgctgaaatgggataaggacaatggtgtcttcactgcagctcatggcaacaataccgccagcaaaatcaccaatatcctggacggcacagtcactgcaaccagttccgatgccattaacggtagccagctttatgacttaagcagcaatatcgccacctacttcggcggcaatgcttctgtgaatactgacggtgtgtttaccggtccaacctacaaaatcggtgaaacaaattattataacgtcggcgatgcactggctgcgattaactcctcatttagcacgtctctcggcgatgctctgctttgggatgccaccgcaggtaaattcagtgccaaacacggtactaatggtgacgcaagcgtgatcactgatgtcgcagatggtgaaatttcagactccagttctgacgcagtaaacggctcacaactccacggcgtgagcagttatgttgttgatgcgctggggggtggtgccgaagtcaatgcagacggcaccatcactgcgccgacgtacaccattgctaatgctgattacgataatgtcggtgatgccctgaatgctatcgataccactcttgacgacgctctgctctgggatgcggacgccggtgaaaatggtgcatttagcgccgctcacggaaaagataaaactgccagtgtaatcactaacgtcgctaacggtgcaatctctgctgccagcagcgacgcgattaacggctcacaactctataccaccaataagtacatcgctgatgcgctgggtggtgacgcagaagtcaacgctgacggcaccatcaccgcaccgacttacaccattgcgaacgccgagtacaacaacgtcggtgacgccctggatgcgcttgatgataacgccctgctgtgggatgagactgccaatggcggtgctggagcctacaatgccagccatgacggtaaagccagcatcatcactaatgtcgctaatggcagtattagtgaggacagtaccgatgcagtgaacggttctcagttgaatgcgacgaatatgatgattgagcagaacacccaaattatcaatcagctcgctggtaacaccgacgcaacctatatccaagaaaacggtgcgggtattaactatgtgcgtactaacgacgacggcttagcgttcaacgacgccagcgcacagggtgttggcgctacagctataggttataactctgtcgccaaaggcgatagcagcgtagctattggtcagggcagctacagcgacgttgatacgggtatcgccctgggtagcagctctgtttccagccgagtgattgccaaaggctcccgtgacaccagcataacggaaaatggcgttgttattggttacgacaccacggatggcgaactgctcggtgcattgtctatcggtgatgacggtaaatatcgtcaaatcatcaacgtagccgatggttccgaagcccatgacgccgttacggttcgtcaattgcagaatgcgattggtgcggtcgcaaccacgccgactaaatacttccacgctaattcaacggaagaagattcactggcagtgggaactgactcgctggcaatgggtgcgaaaaccatcgtgaatggcgataaaggtattggtatcggttatggtgcctacgtggacgcgaatgcacttaacggcattgccattggtagcaatgcgcaagtcattcatgtcaacagtattgcgataggtaatggttctacgaccactcgtggcgctcaaaccaattataccgcctacaacatggacgcaccgcagaactctgtcggtgaattctcagtcggtagtgcggatggtcaacgtcagatcactaacgtcgcagcaggttcggctgataccgatgcggtcaacgtgggtcagttgaaagtaacggatgcgcaggtttcccagaatacccagagcattactaacctggataatcgggtaacgaatcttgattcacgcgtcaccaatatcgaaaacggtattggcgatatcgtcaccaccggtagcaccaagtacttcaagaccaataccgatggtgtagatgccagcgcgcagggtaaagatagcgtcgcgattggttccggctccattgctgccgctgacaacagcgtcgctctgggtacagggtctgtggcaaccgaagaaaatacgatctctgtaggttcctctactaaccaacgtcgtatcaccaacgtagctgcaggtaaaaatgctaccgatgctgttaacgtggcacagttgaagtcttccgaagctggcggtgtacgttacgacaccaaagctgatggttctatcgactatagcaatatcaccctcggtggcggcaacggcggtacgactcgtatcagcaacgtctccgctggcgtcaacaacaacgacgtggtgaattacgcgcagttgaagcaaagcgtgcaggaaacgaagcaatacaccgatcagcgaatggttgagatggataacaaactgtctaaaactgaaagcaagttgagcggtggtatcgcttctgcaatggcaatgaccggtctgccgcaggcttacactccaggtgccagcatggcctctattggtggcggtacttacaacggtgaatcggcagttgctttaggtgtatcgatggtgagcgccaatggtcgttgggtctacaaattacaaggtagtaccaatagccagggtgaatactccgccgcactcggtgccggtattcagtggtaatgatccattaagttagtgtgactaagggcaaacgccaaattgcctgatgcgttacgc

SEQ ID NO: 201 - DNA  (genomic), 5407 bp; double-stranded, linear
atgtctcttgcagatttgccagctcaaaccgtttttcaaaatttaaatcttgaaataataaccaataagttgacatcggagataagatgacctcaacattatttttctctctcgagaaaaaaaactggatagcgtactggaacagagctctcgtattcttattcattaccacctattttttgggtgggattacaaggtataaacatcttattgttattcttatgacaataacgacaatcgtctatctctgcaaacggccaaaacactatctctcactatttaaaacatttctttttggtagtgttgccatattaactattgctgcattgctgtcacttcttcaatcccctgatgcaggtgctagcatgaaggaaattttcaaagctattattgagaatactttactatgcacaatagcaataccgatcatattgagagacgagaaaagagaagatgtcgaaaaaatcgttttcttctcatttattagtgcgttgggcttacgctgtttttctgaattgattacctattataaggactatcaacaagggataatgccattcgcagattatagacaccgtagcatttctgactcgatggtctttttattccctgcattgttaaatctctggcttatcaaatcagcaaaataccgcatttcttttgtggttctaagcgttatttttatttttctgatattaggaactttatccagaggggcctggctttccgtgttagtcattggattaatatggattctgatgtttaaacaatggaagttactattagtaggagtaatggttgccatcattgcattgtcggttattttcacacataaggagatgaccgcaaagctaacgtataaacttcaacaaactaatagttcttatcgctatgcaaatggtactcaaggcagcgcactcgatctaatattagaaaatcctgttattggttatggttacggtaacgttgcatataaagatgtctataataaacgtgtcattgattatccagaatggacctttagacaatcaatagggccacataattttgcgctattcatctggtttggcactggtttattagggctggtaagtcttatgatgctatactgtgcaatattgaaagagtgtataaaaaatggcgtcaagaataaatatcgctcaccatataatgcatattatataatcttactatcttttataggttattttgttatccgtggaaacgtagaacaaattgaaccaaatttattaggcgtttacgccggcttattattagcgatgaaaaacaagtaaaaaataaaaaaggctgcataatgcggcctttttatttattcaaaccaattatgaataacctcttcgaatctttgagttacgccatcccaactgtagtgatcaaacacaaagtcctgaccttgctttgcaactgctgttaattcaggattcgctaacgtttttaaaatatcgctgcttatggagtctgcagtcataggttcttttaaatggaatcccgtagtattttctttgacaaattccgtcatccccccacgcgtactcactaaaacaggcttaccagcacccatagcttcaattgccaccatgcaaaatggttcctggaactgggaaggaatgacgactaaatctgccagtgggtaataacaatgcatcttttcaggcggtatgcttcctaacataatgcaacgatccttcaaacgttttgcaatttccctgacattgcgttgatatgcacctttgtcacttttactcatttctgtataatcaccaatcacaactaattttaaatttttgtgagcagcggccaatttttcgaatgattgcatcaacagcaatatgcctttgtcagggacgatacgcccagcataaaaaataattttctcttcaggggagatattaagttcgcttctagtgatcggctgaaaattagattgataggtttctaaatcaattccatttggtacaatctcaatatctgcatttgctaaataagattggtaatactttttcaagtataaactaggcactatcattttaacattttgctcaagcaattttggttcaaatgcattatgcatatgtataaccactcttgcctgaggagctcgcttacgaatttgagtgtatagcttcatgctattatgaactacaataacactttctttcgttataggaaaatcatgtgcaatattcaatattctctgtgaatatggaagaggatcaagtcttgtccatttttgaaataaccgcttatatatgcgactgaatccaaccctatgaatactacaattatcattaacaaaggtgtaatttgagtatcctggatttttgatacaaacaatacgatttggaaaattggtacgctgagcaacctgatacatccacgtttcaacagcagccgctccgcgaggaggaattgaaaaaataggagtaaccgtaaatattattttatcaaccatctcgtatattaacctttcataacattatatttaattgctgtaaaaacaccatcgagaaattttttctggtaaagcaagtgtttatatttttctttgtactcatgttttttaacagcttttttataaggtatatttctccatggtgatatattataaatattacgaaaataatctgcagaggcgtagttcgcccaatcatgccatggcttagttataccagtataatgtatgaagacagtgtcatcattaataaaccgggtgtaatattcactatttttttcttcaaattctgactttatagtataaatacaattatattttctcggtaatattttagcatgatgtagaaacattaagtttaaaatatcttgatccgggtactttaatttttttataattgactcatctgataatagatcaaagaatttttccgttagtctttgttttaaccattcccgtaaattaatatacattacaccagagttaaaatagctaccgttaaaatcctcattacacaaacgctcagcgcttttactttgcatagcatctacatcaattaccactgccccatattcatctttaaactctaatgctattaactcgttcaatgaacccttacagacgatatcagcatcaagatataataatgaatccaatcgcgcagaaaaataatcaaatgaaagcaaacgataataaatagatactggccagatatttgattgaggtagcgccttcaatggctcagaatcaatatgatataatttaattactgtttgatacttcgttgctaattgtgataataattcaatatactctttgtctaagtaatcagcgattatgtgaaaggtaaatttgttttgtttattattttcaagaattgaagcaattgaaatcgcagccccaacctggtagttctcatcaataccccatgagacattaaacgtttcccgttcatcaagtttaacggggcgcttgtccagttcaattatatctttaaattgagtaagatgtttaaaatccaatttaattacccttcattataatcattatttgctcttcaatcctagtttgacttttacatccctgattacttttttaattttctttttgaatataagatatgtatagccaaagtctttcaattcattttttatattatagtgccgttcaagatcaatgcgatcttttgcttttaaaacagcggttgtttttttacctgaaaggtcaattagtcttaaacctttttcggatactataaaatttcccttatgaggatcgccagacaccattccatgctgatgcaactcttttatcgattctgataattgatccttcagatcttcagaaatttccaaatactcatttaacccgacaccttcaatatactcaatgagcataatataataatgagcgaaatttaatgttttacgttcagctagcaaaaaatagtcattaattgattggatgccttcaccacgtacccgatcggtttgataaattaaattttcataataatctttttttatgcaagattttaagaaacgttcggtcattttatgctttggcgcataaactttaagtacaagaggtccacgagcagtgtcaataagaatgactttagtatcatcaatagaacgaaaaacttttaatgttttaaccctgcaagttaaaaagtcatttagaacttgctcataaaagggatcattatcttttatgaaaactttcaccccatttatcgttttattatatatcataatgaattattttaaccttaaatctttagaagcatttttctttataatactttaaataattaaaaatgcctgccatataatgcttttgtttaaatttatgttttgcacaataccgatactgattgctatttacaggtttaagtaaatcttctttactccacggagaagctgctttggcgatcaaaaaactacgtgacaccggatagtcagcccactcatgccaaggttttgtaggtcccacatagtgtataaacacggtgtcatcattgactggattatcaactttgtcttttaattcatagttaatactatatcgggtattatatttctccgaaataaacttcactttaccattcaataatacattcagtacatcttgatcaaggtgggtgattttacttacccaatctgggtcacgcaacatttcaatagcttttgacgaaatgttatttagattccactcatcaatatttatcagtaaaaaaccagcattgaaatatccagaagctaactgtggtgtagttaataccgaggctcgattttgccaccattcaacatctctttcagctacaactgcggcaatttcattagtagaaaattgataatctaagagttctttaatactacccttgcaagcaatatctgcatcaagatatagtattttttcatgtttatgatagaaataatctgcaattataaatcgaaaatatgttgcgtaagtccagtttttcgtgcttggtaatgacttcagcttatcacaattgataacataaatattaattcttgaattatattgttttgctaaatcagaaaaatataatttgtctttatcactgatataatctgtgaaaacatgaaattcacaagagatttctctattgtttaatagaatagatgcgatggctacaccacatccaaaaagaaaatttctgtcaataccaaatgctatatcaagagtatttttagatcttatattttgataatgaaaattatactcaaaaaggatgatgtcactatcattgagttgagacatatttattctgtatccaaaattttggcaaaaataagttacgggttacaacgattttcgaatcgttctttccctgatttttgtggcttttgcttctgcttgcgacagcagtccttgttcctgcttgagaatgtctttaagcggggcggc

SEQ ID NO: 202 - DNA  (genomic), 39 bp; double-stranded, linear
gacgtacctgtcgtggaggagggcagtaatttatcgaca

SEQ ID NO: 203 - DNA  (genomic), 62 bp; double-stranded, linear
cattagcaaccatattctttcactgttgctctgcgattccttcctgcacgtacagcagaaat

SEQ ID NO: 204 - DNA  (genomic), 140 bp; double-stranded, linear
ggcattatggcactgaagggcaagaattttggtcagctagagaattggcaccgttactggattatcgggactggcgcaattttcaaaaggtactggcccgcgcgactcaagcgtgcgaagccagcaatcaagctgcatct

SEQ ID NO: 205 - DNA  (genomic), 857 bp; double-stranded, linear
tgaccagactcatcacaagacaagtcacgcagtaaatcttcaatctggatagtgaggatatccattgcctcatacgcatcctgtgcaattcgcgccgccattgcgccttccggttcaccacgcagaatttcagccgctgcctgtacgccagccacaatcatttcaggtgttaacatttggcgaagaaaagcgcgattatcagaggaccagccatctttatggcctaatggatgcccccagcctatccattcttgcgaccataacggattggcttctatgggataaattagatgcgcggcatactgaatagcacacaccgcttttcctggcgtatccagcgcccaccagcgcgaccagagagaacgaattaacggcgcggccccacccagagtattgaacaccgccagccagcaaagaacgttattgaaaccacgctcgttatccatacgctgcaacgcggtgtccagtaaaaattgccgtacctgctggcgttgggaagcattcatcatctcctgccagagatagggccgacacaatgccttcattaaggattcttcgaagtgatcaccataaccgccagctaaaacggtttcatgccattgcgccaggcagagcggaaacagatagcgaaacaactctatttgcatcggttcgttataaacgagattgagtacatagtaagcactcaaatcccattcgctgatctgctgccactctttagccgccagcgccttgagttcggcatctgcgtaatcaaattccgtttcccatacacagagcactggcggctcatcaccaaaaatatggcgacagtgttcacgtagcgtttccggttccttccgacgctttttcatttt

SEQ ID NO: 206 - DNA  (genomic), 43360 bp; double-stranded, linear
actctcccgacatcaacaaagccccttataatcccttatatatcaggttttctttgtatcctgaggtcaaacgactttaacccatatcaagttgtttgtgggggtgcattgggggtatcaggttggttactggcggaaattcccccaggaggatggattcatcaaaagctggaggatgtcatggcgctaaccgatgttaaagtgaaaaccgcgaagccaaaagaaaggccctataagctggctgatggcggaggtatgtatctgctgattaacgctaatggttccaaatactggcgtatgaagtaccgcttcgccggtaaagaaaagatgctgtctattggcgtataccccgatgtaacgcttgccgacgcacgtgagaaacgcagtgaagccaggaaaatacttgcggctggtggcgatccgggtgaggcaaaaaaagaagaaaaaatagcgctgcaaatgagtttgaaaaacactttcgaggccgttgctcgcgagtggcatcagacgaaagccgatcgctggtcactgcgctaccgcgatgaaataatcgacacctttgagaaagatatcttcccctacatcggcaagcgacctattgccgaaatcaagccgatggagctattggaagcactacgtaagatggagaaacgtggagcactggagaaaatgcgcaaggtccgccaacgttgtggtgaggtgtttcgctatgcaattgttactggtcgagccgactataaccctgctcccgatcttgccagtgctttagctacaccgaaaaaagtacattttccctttcttactgccaatgaacttccccacttccttactgatctggcgggttataccggaagtatcatcactaagacagctactcagatcattatgttaaccggtgtacgaacgcaagagttgcgtttcgcgcattgggaggatattgattttgaggcaaaattatgggagatcccggcagaagtaatgaagatgaaacggcctcatattgtgccgccctctgagcaggttattgcgctatttaagcaacttgaaccaatctcaaaacatcatcctctggtctttatcggtaggaacgatcctcgcaagccaattagtaaggagagcattaaccaggtcattgaattgctggggtataagggaagactcacagggcacggtttcaggcataccatgagcacaattctgcacgaacaaggctttaattctgcctggattgaaatgcagttggctcatgtggataaaaactccatcaggggtacctataaccacgcccagtatctcgatggtcgccgtgaaatgatgcaatggtacgctgactacattgattcactttctgagctggcctgatgaatgaaagttcggtgacacaaaaataatgaataaccatccagccccaacaggcggatggttgtagtggcacagtaaatttggccacctgattaaaggtgatatcctcaccacaacacaaaacaggtgacttaatgaacaagaaaaccaaacgtactttcacccctgaattcaggctggaatgtgcacagctaattgttgataagggctactcatatcgacaagccagtgaagcgatgaatgtcggttctaccacgcttgagagttgggtgcgccagctcaggcgagagcgtcaggggattgcgccctctgccacacctattactccagaccagcaacgtatccgcgaactggaaaagcaggttcgccgcctggaggaacacaatacgatattaaaaaaggctacaaccgcgctcttgatgtccgactcgctgaacggttcacgatagttgccagactgagtgacagccactcagttgtcagcctctgttctgctctggaaatacaccgcagcagttaccagtactggcgaaaacgacgcgatacggttaatccggcgcgagtcaggttgtgcagcgaaatacgccgggcgtggaaccaaagtaggggctctgcgggggcgcgcacgctggctgaaatgctgacccaaaacggcgtcccgatgagccgttaccgtgccgggcgtctgatgaaatatctgaacctgagcagttgtcagcccggaaaacatcagtacaaaaatgctcgtcaggaacatacctgcctgccgaatctgcttgagcgccagttcgctgtgcccgagccagatagggtatggtgcggagatattacgtatatctgggcaggaaatcgctggtgctatctggcggtcgtcatggatctttttgcccgcagggttatcggctggagcctgtcagcgaatgccgatactgccctgataagcagtgccctgcggatggcgtatgaggtgcgtggtcagccgcgggacgtcatgttccatagcgaccagggaagtcaatatacaggactgaaatatcaacaacttctctggcgttacaggataaagcaaagtgtcagccgacggggaaactgctgggataacagtccaatggaacgcttcttccgcagtctgaaaacagaatgggtgccaaccgatggctacacaggcaaagacgtggcccggcagcaaatcagcagttatattctgaattattacaatagcgtcaggcctcaccattataacggagggctgacgccggaagagtcagagaacagatatcatttttactgtaaaaccgtggccagtattacttgaccactacactggaactcatgctcaccagcggtgagctgaatccccgccatcagcataccgtcacgctgtatgcaaaagggctgacctgcaaagccgataccctcggcagtcgaggttacgtttatatggctgtttatccgacgcccgaaacgaaaaagtaaatcatcagaataaccttctgctccggcctggtgttttcaccacgccacttccccatttctcatctctgcatatcaggaaaaactttagtatgaaaacattacccgatacacacgtacgggaggcatcgcgctgcccgtctcccatcaccatctggcagacactgcttggccgtctgctggaccagcactacggcctcacgctgaatgacacaccgttcgctgatgaacgtgtgattgagcagcatattgaggcaggtatttcactgtgtgatgcggtgaactttctcgtggaaaaatacgtgctggtgcgtaccgaccagccgggattcagcgcctgtacccgctctcagttaataaacagcatcgatatcctccgggctcgcagggcgaccggcctgatgacccgcgacaattacagaacggtaaataacattaccctgggtaagcatccggaggcgaaatgatgaaactggccctgacactggaagccgacagcgttaacgtacaggcactgaatatggggcgaattgtcgttgacattgatggtgttaatctcgctgaactgattaacatggtctgcgataacggctactcccttcgtgttgttgatgaatctgaccggacctcagcagactgcacgccaccatttactgcccttaccggcatacgctgcagtaccgcacatatcacggaaacggacaacgcctggctgtactcgctgtcacaccagaccagtgacttcggtgaatcagaatggattcattttaccggtaacggctatctgttgcgtaccgatgcgtggtcgtacccggttctgcggcttaaacgcctgggtctgtcaaaaacgttccgtcgtctggtcgtcacactcatccggcgttatggtgtcagtctcattcatctggatgccagtgccggatgtctgccaggtttacccacttttaattggtaactaggaacaacatgacatcattaaccccggaagcagcactggatattctgattgcgtggctgcaggacaatatcgacagcgaatccggaattatcttcgacaacgatgaggataaaacggattcggcagcattgttgccctgtatcgaacaggtcagggaagatgtccgtaccctgcgccaactgcagcttctgcaacagaaccggtgagtctcactcaccatacttcattccactgacgccagcctgaacagggctggcgttttcgtttataaaccaaaaggaaaaccgataatgtcaggcatcataatctcccgtccggaagtggacaccgggcatacggacgttatctgctccaccagtatccgacacgttgtgacggtacggaatgcagcactgcaacaaaccgaaacgcttatccggcaactggcagaaatctcagtcctgacagcagcagacattggcggcaaaaccgccctggaccgggcgatgaaacaggattttcactgcggctgctggctgatggagaaacctgaaaccgcaatgaaagccatcacccgcaacctcgactgcgaaatctggcgtgacctgatgcaacgctccgggatgctgagtctgatggatgcacagggctaggatacatggtaccgctcactggagtacgataatattccggaaatcagcgaggcgaatatcatgaatgcattcaaacaactgcaccagagtaaggatgaagtgtttgagcgtggggtgatcaacgtcttcagagggccgaacggaattacaaaaccaattccccctgtaaattcggcagtaaaattatcgtcaacaacttggtgagatgggacagatggagatttcatcttatcagtggaatgcaggcagatcgcttagctgacctggaaagaatgttgcatctgctcagcggtaaaccgctccccaacaaccgagggaatatcaccattaatctggatgaccacctacagtccgttcagggtaaagagcgctatgaagacaagtaaatactttaagaagggcccgcacacatcacattcagaaagccagagctggttgacaggcttaatgatattattgccagacactacctaggaatgttaccttcacaaaaatctctaagaattgattcaattgtgtattttagcctcattccctcatgtaaagtcatttgggggttattatgggggtcaatcatttatccaacacgcattaatcatttaaaatcaatgcattaataatcatattcgactcctgtgatctccgccaaacttcctcttctgaactctcccgacgtcaacaaaagtaagcgtacagcctgaaccgtctggtcagaatctgacgaattagacaaagtggtgtccaccaaataagtagtgggaaccaaagtatcagatatgcagaaaaatgtgactcccggcaggcgaaaaggctgccctaattatcctcccgaatttaaacagcagctcgttgctgcctcctgtgaacccgggatatccatctcaaaacttgctcttgaaaatggcattaacgccaatctgttgttcaaatggcgacaacaatggcgcgagggaaagctgctattaccttcttcagagagcccccagctacttcctgtgactctcgatgcagctgccgaacagccagaatcgctcgcagaggacccggaaaccctcagtatcagctgtgaggtaacgttccggcacgggacgctccgcttcaatggcaatgtcagcgaaaagctcctgactctgctgatacaggaactgaagcgatgatcccgttaccttccgggaccaaaatttggctggttgccggtatcaccgatatgagaaatggcttcaacggcctggctgcgaaagtacaaacggcgctgaaagacgatcccatgtccggccatgttttcattttccggggccgcagcggcagtcaggttaaactgctgtggtccaccggtgacggactgtgcctcctgaccaaacggctggagcgtgggcgcttcgcctggccgtcagcccgtgatggcaaagtgttccttacgcaggcgcagctggcgatgctgctggaaggtatcgactggcgacagcctaagcggctgctgacctccctgaccatgctgtaaatctctttatcctggttgtcacagaataagcccggtaaaatacgggcttatgaacgacatctcttctgacgacatcttcctgctgaaacagcgcctggccgaacaggaagcgctgatccacgccctgcaggaaaagctgagcaaccgggagcgcgaaatagaccatctgcaggcgcagctggataaactccgccggatgaacttcggcagtcgttccgaaaaagtctcccgccgtatcgcacaaatggaagccgatctgaaccggcttcagaaagagagcgatacgctgactggtagggtgtatgacccggcagtacagcgtccgttgcgtcagacccgcacccgtaagccgttccctgaatcactaccccgtgacgaaaagcgactgttgcctgcggcgccgtgctgcccgaactgcggcggttcactgagctatctgggcgaggataccgccgaacagctggagttgatgcgtagcgccttccgggttatccggacggtacgggaaaaacatgcctgtactcagtgcgatgccatcgtgcaggcacctgcaccttcgcggcccatcgagcggggtatcgccggaccggggctgctggcccgcgtgctgacctcgaagtatgcagagcacaccccgctgtatcgccagtcagaaatatacggccggcaaggtgtggagctgaggcgttcactgctgtcgggctgggtggatgcatgctgccggctgctgtctccgctggaagaggcgcttcatggctatgtcatgactgacggcaaactccatgccgatgataccccggtccaggtactgctgccgggtaataagaagacgaagaccgggcggttgtgggcgtatgttcgtgatgaccgcaatgcagggtcagcgttggcacctgcagtgtggttcgcttacagcccggacagaaaaggcatccatccgcagactcatcttgcctgcttcagcggtgtgctgcaagcggatgcgtacgccgggttcaacgagctgtatcgcaatggtgggataacggaagctgcctgctgggctcatgcccgccgaaagatccacgatgtgcacgtccgcatcccgtcagcactgacggaagaagccctggagcagatcggtcagttgtacgccatagaggcggatataaggggaatgccggcagagcagcggcttgctgaacgtcagcgaaaaacgaaaccgttgttgaaatccctggaaagctggttgcgtgaaaagatgaagaccctgtcgcgacactcagagttggcgaaggcgttcgcgtacgcacttaaccagtggccggcactgacgtactatgcgaacgatggctgggtggaaatcgacaacaacatcgctgaaaatgccctgcgggcggtcagtctgggtcgtaaaaacttcctgttcttcggctctgatcatggtggtgagcggggagcgctactgtacagcctgatcgggacgtgcaaactgaatgacgtggatccagaaagctaccttcgccatgtgcttggcgtcatagcagactggccggtcaaccgggtcagcgaactgcttccgtggcgcatagcactgccagctgaataacacatccccgtcaatacggccctcgctgtacgcttaccaacaaaaccccttttaatcccttatatatcaggctttctttgtgtacaggggtcaaccgactcaacctgtatcaagttgcttttgaggatactttagggggtattatttcctcttgaaatattagcaccccataatgggaaaaaggtaatacataacaatggtttttaacagtatctttgttatacaagggggcattgaggatatcaggaaaaatctcaaaatcggtacggacaggaaactacgtgggcagcaaaaacgtatggtaacaccgggaaatgcaacgcccaccagtcgggctaatccaccactccaatcgtggttcgcagtactgcacacacgattaccgggctatacaggagcggtttggtctgaaaacatccatgccgcgtaaaggtaaccgttacgacaacacctcaatgaaaaacttatagtaaacgctgaagaatgaaactatcgttttaataaccgggatgaagccatctaagtaatacggaaatacattgagattttctacaaccatcagcgccgccactcccgtctggggaatatctccctggtagccttcaagaaaaatataaccagataactgcgtaaaaaaagaacaaatggtggtgtccgctattgccagtatacctgagtttactgcctttcagattatcacaatcaatagcgaacagacttttaagctctgtgcgcttttaacaaaacgtccctttctccactttcaccgtataataatacattatttattacccctccaataaaaaccgatattactaatcacatttattaccacacaatttgatatcggtttttattagttggttaccctttcttcgattgctcataggcagctaaatgatcttttaatgcctgtgcaaggggcggtagtccactaggccctgtcggtggcggtggtgcctgacgggcgggcttaaaacctaaagcctcaggacctttcgatttttcataggcagccaagtgctcttttaatgcctgtgcaatgggcggtaaaggtcgggatgccccggatgcctgtccacttgtcggtggcggcggtgcctgacgggcgggcttaaaacctaaagcctcaggacctttcgatttttcataggcagccaagtgctcttttaatgcctgtgcaatgggcggtaaaggtcgggatgccccggatgcctgtccacttgtcggtggcggcggtgcctgacgggcgggcttaaaacctaaagcctcaggacctttcgatttttcataggcagccaagtgctcttttaatgcctgtgcaatgggcggtaaaggtcgggatgccccggatgcctgtccacttgtcggtggcggcggtgccggacgagagggagtaaatgaagtcacctggctgctcacattaaaaatcgttctcgcattaacattcgacgagcctggagaaaaaggggaatgaactttcaccggagtaagacgcacggcctgaggggctacagaaaatccagttccccccgcagagctcactcgacttgcgatacctacaagctgccgccctagtgtagaagcagcgttactaattccattaagcataatttatgcctctttatatctaagcttggctaactctcatatatatcaaaacgaataataaaatgatttttaaatcaatataaattaaaatcctcgtacccagccactaccattctcatggaccaaactgtacaataactgactcgtctcatcatccatacagtcctccaaagcctttaccgcatcattttttctatttaatccaaataagataataaattctaaatgtgcgatatcttttttatcaggtataatttgtgggaatacattcaggatagcttccgcatatttgggaagcttatggtttgccgcagctacagccgcccacaccagtatcttattagcagaaatatcattaaccattaaaattaaaaactacggttagaaatggttgagaccagatcttttatcgttttcaacattccactttctacgttaacataagcagaatattgctgaaccgcaaactgcaactctaacattttttcagggtcattaaccaaatcggtgctattaagtaactctggcacagaatcgctcagcgttttacctacttcacccatttgttgagtaatttcagataaattcattaaatttccctcagaagttaataaaataaaaacttttaactatttacgttcattacgaaccaaattccgtcttctgtttcttgctgcacggcaccctttctgatgaagtaattaaacaactcttcgcgcttttgacgttctgaatctgaaccaatcttagatttcatcgcgctgattttcttaatacccgaaaaatggtgatacaactcttcgagcaaatgagtcagcgataaaacagggccgttaagccctgtttggttacgtgcttcaaaagagcacaaaatcagttcttgttcatccagtctgtacgctaatgaaaaaaaaggtgtctcaatccgccatccgataaaaaaggcactgccacaaagaaactccttctgtattgtgtaccctttttgttcaagatagtaattaaacacttcatcattaaacgtatcgaccatgatcaattacccagctaagcgacccgattgccccatacgattctggacctcaaggagatcgcggacagcggacgttatatcacgcagacgagtcgtgatatcatcctgcgttctgcgaacgtcttgtttatacagctccagattcccctgctggaagttttccagcgacttcgcacgttgttcattaacctcatgagtcgatttgacggactcagatattgttgttggcaacgttttcgtaccttcagcaagactggtcacggcaacaaatgctgtggtattggtcagttcatctacggaattcaacaacttattgattctgcttgtcttctcggcggcgtctgcaagatcttcagcaaagtcagaggctttcgcaacatcatctgcaacgccagatgcacggctggctgctttcgttgttgtggccatcgctttctgcatcgcactggatgcctcctctgcgacatcagcaacactttccgtagccttgaccagagctttatttgcaacctcagaagccgcaccagcagcctttgaagatgcagagcttgctttttcagcaatctcaccagcccctttagccgcgttgttcattgctgcaaaagaacctaagatccccaatgctgatgaaataatcccgccaaccaaagcagcggttgccgcggcttttttttcctcaatagctttattctggctctcaaaaacggcctgctgaatctgatagctttgcgccaattgtttttgttggtaatcctgcaatagagtcaccatcttgccgaggagtttttgaatttccagcatcagcttacaaatatcaaccttaccatcagtaagcagagatgaatcaattgataaagcagatgcggcaactgcactggaagcgccggtcgtactctccgaagcggaattaaccatcgttacttgagtattatcaatagtattcataataaaattctctttaataattaaattcggccactaacaatacgactatttacccgtgctgaatcggacatcagttgagaaacactttgtaaatagctcgcctgattttgtaactcgcttgccgctttatccagctcgagcttcgcactctcacctaagctttcactctgtcgagttaagttttgcaccgcgaaagcagctaactgagacaacatttggagttgcgcagcctcattattcaacgcagttgtcccggcagaacgaataccgttcgtaacgccctcagccactgtcgaaatttttgcaaaaacgtttttaaccagcgcttctgccgccttctcaacgacttttacaacgcttgagccaattttgttagcaacattaccaaatttagataacagtgaagacaccccgccaacgccggctgtcagaatgcttgcggccatagatattccgccaaagacctgtgctgcagtctttaatccctgaggggcattttcccccattacatcgactgccgtttgcagtgccattgctgttgcaccaatggcaacaacagcccagagtgctgggttaaaaacagcggcaacggctgttaatgcgacgcccaaccaaccaaagacctggccaacaattttacttttttgtgatttctcttcggctttctgttgttcttcgagctgttttttatactcctgcgttttattctccagcgctttagtttgcccatccatataaatctcgttagagtttttcagactcgagactttctgcgcggaagtatccagggataacagagtgaccatcatcatcatttgctgagggtcaacggtattcacctgagagagatagggatagcttgtgcgctgtggctctgcctcctcagtgcgacttgtaacctcaccactaataccaccaaacaatttactaaggacatcctcagcagcagagggcgtcactaatgagtgacctgccggcggcgtcggtaaagggctactttctgtccagcctgctgacgagttcatggatttaaccagttgtaaatccagcgataaacccgtttcagattgagtaataccagaagtacccgaggcggtattaaccccagacgttacagacagggtatcgttatttacgttaagcatagttatctccggttatttaccaagggatattgctgaaatagttctatattgtagagattgcacatcagaacgtgcactcgttaagagatttaatgtattcgacatttgctgaatttcgagctggctattattcactaccgttgtcaggttattcgctttagctgaaatagccgccttcactgtttgcagatcaccagcgcttaaatcaccactaagatcacgaataccagttacacttatgtcattacgtggatcgtttatatagtcaatcacgtcttgaggaagtttggctttcgcattcttatcagtgctactctgaacatcagcaattttggcatccacaagattagccatcttttgtgccgtggttgacgctttagatgcctcattcatatcagcaaactttgcaatcgacagattactttgtgcctgatacatataagaaaacatgagaatcgcagcctgaaaaacaccgagttcctcaaatagcttaaccacctcatccttcgacatattacctaagtcatagatcgtcgatgtcgaagaactcgcactcacattaacaacggatgttgcatttgatgtatccatctatatacctcttgataatttttctcaggaaaacaaaaaaattattgagtaattaatatcaaataatttcctccttatagtcgataactttaccaatcattaataatgcattctctctctgctcactatcaataaagcaagcatctggtaatgatgtaaaaaagtctttcaataaatgaaaataataaatatgtttatcttcgacaatcgatacccgagaaggactctccagcaaccagtcttctgttagccagacatgttcaataatcgataacacttcatttaaaatgatatctttatctttcttaatagagatcgaaataatatctgcatagttatcaagtgataaaaaaatgattaccctgcataaatcactaataattgaagatgtctttactttgtcttcaaaagaagacatataagagagatcgaacgacagcgccctaataatgacttttaagtgcttctcacgctcgggaagatccttaatctccataaaccagtcaagtaaagaggcgccattttcagaatcctcatccttagccttttcataaagcttcttgatcttctggataccttcctgatttaactcacccacccctaaccaggaaagcagagccagctcccaatcatcttcgcctaataaatctaataataacctggcatatttcttttttaattcaatcttaacaaacttagattgcaataaagaagatattagcgcaacaatttccccctttggcatgttgccaaacatcgccaaagtaggatcgtgttgttccagcagcccgctgttttttaatgatagttcttttattttatcactatcggtaagagtaagcagctcttgcatatcattgagcagcttctcgattgtcgagccttcctcttctttccttgcgctacctttgcgatatcccaggcttagcccttcaatcgtttcagaaagcgatgaactagtaatcattgctaattcattttgcaaatttattaatggcgaagaaatattagaagaatttttttgcgttaattgctgagattctaattcaaaatctaatgaattagaattaaaaacagatgcggggttttgattaaattcaataccattagccattggaaactcacgtaatcattaattatgaatattccattaaatagtactgtacaacagcttcctttctactctattcttagacgatgtaagttcaccatattttttctcattgttcaaccaccaggatgaataaaatttaaaaatgttatcctcatataaaataaaacttctcaatggtgcgatgcgtaatcgggaattacaacttccgatgggaaacctaacgctaggtacggaagataacgatattgtttactttccccttgaacaaggcctcaatcagtttttacttgatatacgtgaggaaggtgttttccttttatctccggttgaattttggattgatgggcaacccacgccctatgaagcagataaaccattacctgtcggaaaggttattgatatagcgggatgttgcttcatcattggtgatattgaccattccttgccattgtctgatgtgccagaaaggttctctgccaaaagtcgacgcaaaaaacgccttatcctggcgagcgtgattggtgctacttttgcgttgtctggtgccatcggcagttacgttttgctttccccaaaagctgaacccccaacgtttaccagagctgatgtatatcagcagctaaaagaaaacaaacttcatgcaatcactctggtatggcatgggaaaaatatcgcgctttatgggcgttgcgaatcaaccacggatttaactccattttttaattacctaaaagaaaaaaatattttttattacaataatatcatttgcaataaccaaatcatatccgcaattaatgatgtcttaacggaatacggttacaaagatatcattattacaaaaggtaataagcctggattctttctgttatcgggatacattcccccttcacccaaatggagcgaggttgaaaatctgttactgaatacgccaggagttgcaggatgggaaatacacaacaacagtaacaataaaatcaatgaactggcatcagagtttaaaaagaataaactaataaactatgtcaatattttcaaaaagaatgatgtcatcattgttgcgggggaagtttctcaacagaatgagagtaagatccttgccattataaatgcaatgaacaaaaatagtaacgccaagatactctttcagaacattcagccgtacatttcagcagatattttccccggaaaaatactcagaatcagcggtacgatgaagaatccaacaattgctcttgataatggcaccagcctggggattggtagcattctgaaaggaggctatgtcatagacgcgattgatcctaaagatggtatcaacatctcccgcccagacgaatatatacatattccactgtcgtattaatttcttatcctcttccccctcttcggagggttttttattgtgtggatgttgtgagcatagttgttgcttgatgtgattcagctttggtatcagcgtggttggatcaacctacatgagaaaacgtgaatgtgtctctttgaaagagacctattaagcagataaaaagaccagtagtagatttgattataagaggttatttcttaagaagaaataattatgccccgactaaaacaatacatattttagccggggtggttatggaattattctacacaaaccgcatagacatttggagtattaacattaaccccaggaagagggttttgtgttattaggttataagtgcttgatactccagaacgctgctcactagatgtctgtttaatccaagcagttattgagttcatagaactataatggctatatttatttgcagccccccatgagtcataaatatctgacaataccgtctgtgtggatggtaataaatttttgcaaatggacatagcatcagcataataggcttgcttatccacttttatcatatacgacggtgcttttatagtgtaacttactgtttgcttatcaccagatgtggctttaattacgacactgcctttaccattcaaagtgactttccctgatgcatcgacagtcgcgatactggtattttctgaataccatgaatatgtaccatcaccaccgcttgctttcagtttaaactgaccatattgcagccaaatattaggcaactcgcctctgacattgttaccaataatatcaaccttgttgtcaattttcagttcatcaaaaaaagtgacctcagtcgctttaacctcagccccatcactgactgtcgcactaacagtcgctttaccggcggaactggaagttagtgttatcgtcgcacgaccatcatttcccgtggttgcttgcgtttgagacttaccgttgaacatcccaaagtttgttgagaatgtaacggattgattattaactggctgaccgtttttcataacttttacagtatatttaatagcatccttaccatttgctactgcagttgtcttatcagccttaatctcagtaatgctggccttggtttgatcaaaaaatataaccgcactggcattaagtgctgaagtcatctccgcggttttagcagacacgacgacctgtcctggcgtactcgacttcaacgttacggttgccttaccgttagcatccgttttggcactatttgccccaagagttgcagttcctgaaacaatattaaatgaaacagggacattagcctgagctaccccattctttttcaccgtcgcggtataagtaatggtatcggcgttatccgctttagccgaagtcttatccgccgtaaagtccgttaccccaacctggtcgacaacttgaccattcgacagaacggtaatagtaagctgtacattgttagagctattgccattacggtcataggcgcgagccgtcactttataaatattgctgccaccttgcacataagcaggcaaaatagcctggtagtcttgtgcgctttggcttccgctatgctgaatctgaccgccctgactgcgtaatgcactatcatcccagacgatacgatccagaccgtatttgctcttaacgatcaactgaatcttctgcgtactgtgttcagtaccattaatatcatgcggaatattcagagaaagaatatcctgcttcttgtactccagaataatattgttattacgctgaaccagatcgtaacggctgcctgataatgttcttaactcgttaacatactgtggttcaatttgctgagaccacgatttatcaaactgataacggaactgcattgagtaaaggagatcattttcattacccgtaccatgacggtaatcgatccccatcgtcaccagaggaatcggagtatagtttacaccaacggtcgccgcaccaggattcgactgcagcttatcagaattaaacaaagcaacattatcaccataatactgctcatatatcagcttggcgcctaatgccggatatgacggtagatagccattaaaacggatatcgaagccatttgctgggcgctcatcatagtctttcttattgtatgactcatgccagccgctcatgcggaaatagccgttaacgctacttttgaaatagtctcgccagtattcgccaccaatacctaaacgggtattatcaccagaaaaatcctgatcaatgaagacgttatagcccaacatgtttgcaggaaggaaaaaacgctgacccgcacctaaatttgccgtaaagcgggagtcaatgtaacgcgctccgacctgaccaaatgccagcattttttcggaatcatagaacggtaataagaagtccagtgaactaccgtcaaagttattaccactctgcagattaacctctgccgttccataatgttgtaaccaggcctgcaactgtgacgaagcctggttaccagcgataccaagagcggtatctttcgcgtaatcgccgttcagagatcgcgactgaagctggctaccgagactcgccgcctgttgtgccgcataatttaatgccttgtcatcggtcatgttgcttttggtcacgtccggggacattttagtcagtttattcgtgtgaccagcaacaccacctgcagcaacaagaggtgccgaacctaaaagtggtagtgcactgtattcaaagggaagttttttgagtggcaaaatgatctgctgaccaggcgcggccttcatcatttcgctttcagaactgtataaatgcttattcaacgaccaaatcgtcgataaattaatatcttgcgatttagaaagatcggcaacagtttcaccagttttcaacgtataaaaaaggcgattctgatagctatcatgagttaacagttttgaatccgaacccaatttaaaataattttcaccatttgcaaatgaattctgattaacataaaaaaacaatcctaaaccagcactaagcataatcaatgttttttttagcttatgcttgtgccgggtccgggtataacaaccatgagtaatcatgttatggctccaccacaatgagttagaatgagaaataaattatattaatagatcggattttatcttccggcgtaataatgtttattgtcgcttgaactgatttcctctattttcatatgttcgttttctaatgttattccctgattatgtaataccaaatacaggttttccattgacttaacaacgacttctatttcattctcgagtttttcaggggtagcatcatcgagagggaaacgtaacgctaacaacagcgattgtgctccagcctcatagcacagatatggcccaccattctctgcaaaccataagtttgcattcaaaatctcaagagcgaagttagagttatctgtcgggaatttcccacagacaccataaatcatcatatattcgtcattggcatcagataacgaaatataataaatttcatcaatagcaaaagaacacaatctgttttcattaaatgaaatagatccaataccaattttttctgcaaatttttctaataaaagttcagatcttgatgacattgtattttctcttaattaaatttatatttacagaagctcaagagttgcccatcctgcagcaatgttattccctgaaaaattgacgttagttagacttcccccctccctccctctaaataaaatgattatggatatatttagacgaaacgatgggatcccggcgctggtgggttattcgaagtattcacagcgctattactcccccccgttaatcctcccatgtcatggcgtaatccaccacttagcgccagacgcgcataagtgctttgaatccccgcacttggatttcctaataaccgtgcgccgttatcagtagtatcccggggaggatgttgaatggtgctatatacaacagaatctgtattccccatattctgaacagacgtattagaattagaagtcggcacctgcgaatcatgcagcgatgttttaacatcagcatacggattctgcacggtccctatgctggaagtgtcaaagaaagtcgacgaggtgctagccatcgagctacgtctgctctccatggtatcttctgacccaggggtatctacattgccctgtgcaggtgtattatttgcaggcttattctctaccgtacgtgcgcttgtagttgtagttgtagtagttgttgttgttgtttgttctaccggctgattttttcgatgaagcgcagcggtgacggcaacaccaattcccccaccaagaatcaatgcgccactaagaccgtagccagcccccgatgaaactttcagctcctcctggcgtttagcttgttgttcatcatattttttttgcgcctgagcattattttcaatggcttgctgtttggcctcttcgcctgctgctttagcctgctcttctatattcgcaacaacatcatctttcaatacccctgacggaatcgcatttccgagctcatcgatattaactttttgattatctgggttctggaacgcttctttcgttaactgatctcttgtcgcagtttcagttgcacttgcagctgcatcagggtcggtcgtggttgggctatccggctccggcgtcaatgcaagcgcctgtacaatacccgtcgccgccaaccctatcagacctgtagcaacagtccccaacgccaaccaaagtttaggatctgaacgaaggctggaagttgaggttgaggtctgagtttctgtggtgttttccgcaccgctatttgactccctcaactccccaacgccttttgactccccagcacctttggactccccggtccctttgggctctaacagctccagtatcctttggcgggcttccgtgatatctgaagcaacggtgaccatagcatgcccagcaccaccacggcctccagtaaatacaaatttgtctttaccttcaggatcaatggactgcaagcgagcgtactcttgatcacttaaaacaacagaggtctcaacaccattcctctgaccgacagcaatatgtttaccatcttcctgagtttcaactcgaaataccgaagagccaatctgcctgttaagagtatcgagcggaccatgatcatgaagaacttcaaatccatcattcagtgttatctcagacgccgccaggcgcatcggatttacaggaagtccaggaacatcactggcacgattgtcgccagaatcagccatagaattccttacaggcgtaaatagcgcacgagatcccaacggccccgtagagttaatgagctgaccacgcccccctgcaccgtcggtttgtgaaggtaatggaggtgcaggaggaattgaattattcacattgggattatgaccaagattaccaataggcataaatatctcctttttattttatgtaaatagataacaatcctttattttgctattacataataatgtatggtatacagcacgtagtcgataaacggctgaacatgacatcgaccaaataaatcacaatctgatttttgatgcaagaaaataatgtgctaaaaacacacatcgggtaacaaaataaaaataattatattatataaaagtaaacaccacgtgaaatcttaataaaacatttcataaataaaattgcagcaaacattcatttatattaaaaaacacagccaaagaaaaccaattaagcaaactataaatcttaattaataataaagtttattaagtttctttatcgcgttttttcttacatcaacaaaggccatgctatacaccaggaagcttaatttatacctgacaaggttatccctacaatcgggtatcctgtacatgctctaaaatcgcattctgagtaatcgcttttatctcactgactttgaagccgctaaagttgcgttcaaatatttcttgtgagacttgttctatcatcttcgtctgggtgttaaaacgtgttattggatccactcttttgccgcactgctcatcaactttctgattaaagtatttattggactgcaagaagtgaccaattgatgattgtgccccgttcatatcaagaggttgctgtaacgcattttcaacagctctaaaaatgtgacctttagtctccttactaatgaccgaattattactcctgcaatagtcatccagagttctatttactgttctggatatataagtcgtctgctcctgctggaaccattgttgggtatcgccattacgagtttgtttggctacagcctgcaggagttggttagtcagtttgccatgattaatcacaaagttcgactgcacgggcatgaacctcatacccgtggctcccgtacccgcttgcattgcagctctggtaaccgcaggtttaagcgtctgtgcagtcgcctgaactaacgatctgcctgccattgtcattggactaaacataccataaacctttataaattatatttcgacagtaaaaaaattgcttcccattaaaaaataactttaaagaataattatcttgtatttatatttgaattatcctccggccttatctacaggtagttgcactacatttatcatatgctatcatgaatatgcaacactattcccgtaatcttatatctacgccttattatttgtatcagaactctcggattaattacgtttgagtatatcaacatgaaaagaatggcaggactacaatatgaatgagaaatttcgcacagaccttgcacatacgtttgggatagctcttgaagagcaaactgacgtgctctctttccacgataacgatggccatgaatggatactggagtgtgcatctcaatctgaaattctgtttttttattgttatttattgaatagcgaatcaatacagattaattcaatacttgaaatgaatagcaatcgagaactgctcggtatgtttttcctgtcattaaaagatgacaacattcttttaaatattgcatttcctgcagataaaattgatattacagagtttgctaatttaatggaaaatggttatctattaaagaatgagataattagatccttgtcttccagacctacagattttttaccttgataatttctgcgctggatgggatcatccattccgtttaacatactcttcatcacagggacctctgatttctggccgctaacgtctctgaagattcagcctgtattatctaaaagcaatgtaatatcagttaaaaagcggaaaaactccagaattataactattctggagttaagtcaggaagaaaactcaaatgctaatcataatacgctataagaggaagctcttgttgctatagccctattatcaagacgttcggtagactgtacacgacgtaacaaagaagataatcctctttcagctaagatcccctccaggggagtacgaggaaaccaggttgaagaaagtggagttatatgtctctcatttaattttctttccaaagccttagtcacaccgccagaaaacacgctaaatagcgttgagaaacatccattttccggtgttattctttgtactttgtacacataatcatcttttgggccatctttaataaagtgaacagcatagtctttgcctctaaaagagacaatggtggaatcccctatttctggatatacccgatgatggcgttgttgcattcgggctttaagctgaatttcatctacgatatcttcattgggtatatgaagccttctgttgaacctgttccatgacgcatgttcacttgtcagaaatgtcttgaataccgctcctgataacgacatgatacatctccctatataacgtattcctgattaatcacatactatgctaacagtaaaataaaaatcttcgttgatttttacaatactcccgtatgctatcgtcgtattattgcgtattaactgacaaccaccaaaaagatggtatccatctgaattaataatgtcatcttttttaacattacgcaacatgtgtatatcaatatggactgtaccgatcgcacaataaatgcgattcatgacagtctcattgctaagagcagataacagatccgcagccagaacatccgtgacagataaattattatcactcagatttactgttgctaaaggggtattaataacaatccagcaccttctctcttgactatcatcaacatgatagagtctcagactatcaccaactctcaactctgtaactggataatcagtccacccaggtacgatatagccatcaaaaaaaagagcattagaatgtggaactaattgccaattatcattaatcagatattgtaaactttgtaccgttgtttcgagtataattacattaagtctgttttctccattattattttctattaccggataaatatctttatttagcatcgtaaattgaacatcatcaactgacacatcaccttccggtaaggcagtctgcattacccataagatcatgagttttatcgtatcttccggtatcagccggctttcgctatacgggaataactcttggcaccactgaatgaactgttcttctgatatccagaaacgcccctcatagcccgagtatgtcaacgtgaaacgaataccatgaccgctgacctcacgaaaatatgcatggcaagcatgacctttggacgtaatatagaggcgaccggttccgataactggcaacaacggcaaataaaaatcgttaattttcatattcaattgtgaactcaatggcttcatcaggaaagatttcttttaacttatcgaaaacatagtcttttttatgatataaaaaaacatgatttctattatttgggcttactttaatagacagataaatgattccgttactacatttaattgttaaaacaattcctcgtaatcttccacaaagaatactaaacgagtgctccccttcttcaaagtagcgtcgtcttcggcccgaggagtaaaacaatctcttccataaagaagccattcgtatgaacaacgtatcaggcgatcttttttttatatgataaaaaatatcattaaaactttcttctccttgcggccaatcatctgatggccgaaaagaaacaggctctatcaaatttctttttagagaaactctagtcaaagtaatgttcctttatggcaaaagataatttttctactgatttattaacatgttgcagattctcttttgttcgtttttgtgaatctagcaatgaacgcttttccttcgaaagtgaagattttttctcatacaatcgctgcttttgctcatcaaatgcattgtttttaatctgatatttatacaacgacactttatccaaattcaccagcgatgcacaatatgcctgcttagaggcaatcgactctttaatggattgctcgcagtcatcgagtttaccatccacctcttttatctgagagttaatcttagccattgattctctcaatcggttcgctctgcttttacgaatagataaaattctgtccaacatactcaggcaaccactttgaataggctttcaatcgttttttcgtaactactgatatctttggtgctttgttgtataaagttctgaattaatttcctattttttattgccttatctgcttcaggatcttgccccatcgtgtactcaccaatacgaataagcagctcaacatttttataagttgcaataagctttttgcattctgccgccgcacgcaaatgctccgatgtaacaacgttatgcataacacgactggcacttaaaccaatatcaattgcagggaaatggttttcctctgcaagttctcgggtaagtacgatgtgcccatcaagaatagagcggacttcatcgccaataggatcattaacattatcgctttctaacaacaccgtataaatcgcggttattgaaccttttggcgcaggccccgctcgctctaataatttgggtaacgaagaaaaaacactcggagggaatcccccccttacatcaggttctcccgatgcaagcccaacatcacgtgcggctcgggcataacgagttacagaatccatcattaataatacatttttaccttgatcgcggaagtactctgcaatagtcgtcgccgtaaatgcggctttcatcctttccagcgcggggcggtctgacgttgtgacgaccagtacacatttagaaagcgtggattgaggtaagagcgcgaggaattcatttacttcgcgaccacgttcgccgataagagcaaggacaataatatctgcggatgcgccattacaaatcatccccaaaagcgtacttttaccaacgcctgaaccagcaaaaataccgatacgctgcccaataccgcaagttagtagcccatcaattgccctgacgccaagtataaatggctgatcaataacctgccttaataaaggatctggtggttcagcatacaagctgcgttcaaacggaagatagggggcagcaatattactctccattggtctgcctatgccatcaacaagccgcccaagtagtgcgtctccaacacgaatcttgaactcatctccctgataacttaaccactgaccacagtacatgccggaaacatgctcaaaaggcaacaagaaaacctcatcttcatcaatagcgatcacctcggctaaacgttgactgggttctatcttataaaaggcgccaatacgcgcttttggtaaacgcgccttaataatcgtcccgccgatattgataatcttgccttcatatctggtagacgaatttaatgataatgccggcacagtgctattgagcactttctgaatacgtgggtatttttccaatacagaatcatgctctgaaatcatttaccgttcctaatactttaagttcgatattattcccaacctcctgaaaagagagcacggggactgacgggaacgaaccttcaatcattttcttcacatagcgcctgatatctaaagcggtcagaatgacgccgttccccgttggattcatgatattttttaagaagccaattatctgctcagttcgctccggtgagatattcagatacgaacctgatgacgtttgtctgatcgactctcgtagctcattttcaatatcagagccaataagccaaacgttcagaagtgtaccgctaacgctatagcgacctaaaatatgccgacgcagggcaatacgaacgtattcgcacaagataaccacatccttttcttttgttgaccaaaaaataagcgtctcaaagatagttctcaggtctctaattgagacattttcctctacgagacgttgtaggatgtcaacaattttgctcaaaccaagctggcgctgcagctctttcacaagctcgttatattttctctccatgatgtccatcaaataacgcgtttcttgtacgccgatgaactctttggcattagacaatacaagtttctttagcaaaaacgttatcttatcatttgttgttgcataaacatccatacctgtaaggtgagcgagctgttgattagtcttattcgtcttatatacgatagagttagtcgaaagcttttcctggacaaattcgaatgatatctctgcatgcccagcctcaaaatagacagtatcatctataagagtatctttgtatattgactcttgatagagcaaaaattctattgcgctatcattatttttaaccggattaacaataatcttaggcaatggaattccactttcctcaaagaaattccaacgcatgacctcaatttgctgtgtaatgtctgaactataaatattactacttaagtttaaaatcaatggctcagcgcccggtgagatgttttggctattagacaaatcagctcccatagcatccttattattgccagttccaaatgttcttttcttctgtaatttccaggctatccccaacaggcaaaccgccagaaataagaagaccaatgcaggaaagcccggaataatcgccattacgagcattagtgcggcactgattaaaaaagggcgactattaacagaaacctgttgaacaatatcacctgcaaggttttcttctttttcgctttcaccgggcacacgagtaacaaccacgcctgcggtgacagaaataataagcgcagggatctgggcaaccaaagcatcaccgacagacaatacagaaaacaggctaagtgccgcactaaatggcatgtcaaattgccacataccaatgagcacgccaccaaaaaggttaactaaaacaataatgataccagcaatagcgtccccttttacaaacttcatcgccccgtccattgaaccataaaactggctttccttttgcactcgggagcgaagaacttttgcctcaagcgggtcaataacgcctgcgcgcatatcaccatcaatactcatttgctttcctggcataccatcaagggaaaaacgagcactcacttcagcaacacgctcggccccttttgtaataaccataaattgaacaatggtgataatagtaaaaataaccaggccaacaacaatattaccgccaacaacaaagttaccgaaggagtaaataatgtcacccgcatcgtgatgcagcagaataagtctggttgtactaacactgagcgacaggcgcatcaacgtcgtaatcaacaggattgtggggaaagaagttagttcaagaggattttttatatagattgagagcattaataaaagtaaagctgtcgaaatattaatcgcgataatgatatccaccacaactgttggtagtggaataatcatcatcattacagccataaagaagaagagagccagaataagatcgtgatatgactctgcttttttaaatatatttaagagtttattcatgatgtcatcctgcgaacgcgctcaataatctgcacatgctgttgaaaagtattcattagaaaaaaaacatcgatattggttaacaaacaacttaagcacaatttattatcgtagacaaaaatatgttcaatcactccctgcgtacgctcaggagcaagggcactaaagaaagagaaaaatgcgttttcgttatactctaaagcaaacgtaacaaaaacattattatcaattatttcaataaaaaaagaaaacccattaaaatcaatttcaacacggttatcaaataaataaaaatcatttcccaataatcttaaaaactcttcaacgtttcttttaactaaaagattcatctgcaggctctgaagtaagtatacgtgtgaatattattgcttgaaaaagcgtattggataatatatacagtatatgtactttatgtacattgcaactatttaaataatataatagttgcctatgggataatttggttatttataaccaggtaaatgtctaaattagacaaaaggagaaagatcaatggaagcagcaaatttaagtccttctggtgcagtaatgccgctggcgacctcactcagtggaaataactcagtggatgagaagacaggagtgattaaaccagaaaatggaacaaatcgcaccgttagagttatagccggattagcacttaccactacggctctggcagctctaggtacaggtattgcagcggcatgctcggagacgagcagcacagaatacttagccctgggtattacttctggcgtactaggtactcttactgcggttggcggtgcattagcgatgaaatatgcctaaccggcccatcgcataaataaaagatagaggtaatggatgtattatgcccttgcctctttcataaaaagaggctaacagtaaatatgaacaacattaatcaatcggaaaacattaatattcaattaaataaagcgccccaaacaaatttcgttgatgagcatacctcgttagcctcagccccctctgcggcaggtgcggctcagtttcttgatcaattactccctaaaacagcgggagtgtcttctccagaacaagtgttgattgaagaaattaaaaagagacatcttgcaacaatgaacagcgatctcagtttcgatgctctatctgcaggtgggctctcgccagaagacgtgctcaccttacaaaagaatgtgctcaacgcaaacgtcaacgttgatgtcgtatctaagttagcaagcctcctttcaacatcggttacaaaattagtttcgatgcaataaaaatgaaaaaacacattaaaaacctttttttattggctgctatttgtttgacagtggcatgtaaagagcaattgtatacaggattaacagaaaaagaagctaatcagatgcaagcactgttgctatccaatgatgtcaatgtttccaaagaaatggacaaaagtggaaatatgacactcagtgtggaaaaagaggattttgttcgcgcaataacgattttaaataataacggcttcccgaaaaagaaatttgcagatatcgaggttattttcccacctagccagttagtggcatcgccatcacaagaaaatgcaaaaatcaactatctcaaagaacaagacatcgaaaggttgctaagtaaaatacctggtgttatcgattgcagcgtttcattaaatgttaacaataacgaaagtcaaccctcctcagcagccgttttagtcatcagctcgccagaggttaacttagcaccatcggtcattcagataaaaaacctagttaagaatagtgttgacgatctcaaattagaaaatattagtgttgttatcaagtcatcctcaggacaggacgggtaatatgtatgaacaataataatggcatagcaaagaatgattgtgactggctaacggcccttgattttgtaaaggatgtcaacggttcaccaacgcatctcactttttatatctaccaaaaaaatgctttcttgcacgattttggaaactactgggttctatatattgagcttagtggtgattttcgtcaggttccaacagatacatttatcagactctgcaatatcctggccgttagtaacgaatataaacaaatgggtattttcctgtctaataagaagtggtatctttgccaaatttttcataaagataataatcatcgcgcaaacatgtcaaaagcaataatgcaacatactctcgcctctttgctcgataagcaatttgataaactagagcaattatcttcatcggatacaatgatgccgccaacacacttgttttctgatataggacgaattgtgtaatgaaaaaaataagtttttttatttttacagcactattttgctgcagtgcacaagctgccccgtcctctctggaaaaaagattaggcaagagcgaatattttattattactaaaagttctccagtacgtgcaatccttaatgactttgctgctaactacagcattcctgttttcatcagtagttccgtgaatgatgatttctctggcgaaataaaaaatgaaaaacctgtaaaagtactggaaaaactgtccaaactatatcatctcacatggtattatgatgagaacatcttgtatatttataaaacaaatgaaatatcaagaagtataattacaccaacatatctggatattgactcactgctaaaatatctgagtgatacaatctcagtaaacaaaaactcttgcaatgtgagaaaaattacgacatttaactcgattgaagttcggggtgttcctgaatgtataaaatatattacatctttatcagaaagtcttgataaagaggcacagtctaaagccaaaaataaagatgttgttaaggtctttaaactgaactatgcgtcagcgacagatataacatacaaataccgtgaccaaaatgttgtcgtcccaggtgttgtctccattctgaagacaatggcaagtaatggttcacttcccagtaccggtaaaggtgccgtcgagcgaagcggtaacctgtttgataacagtgtaacgatttccgctgatccacgtcttaatgcagttgttgtaaaagaccgcgaaataacgatggatatctatcagcaattaatttctgagcttgatattgaacaaaggcaaattgaaatttctgtctcaattattgatgttgatgcaaacgatcttcagcagctcggcgtaaactggtccggtacgttaaatgcaggacaaggtacgattgcctttaatagctctaccgcacaggctaatatcagctcttctgtgataagtaatgccagtaattttatgattagggtgaatgcgttacaacagaactcgaaagctaaaatactctctcagccttcaattataaccttaaataatatgcaggcgattcttgataaaaacgtaacgttttatacaaaagtctccggagaaaaggtggcgtctctggaaagtattacaagcggaacattgctgagagtgacaccacgtatacttgatgacagctcgaatagccttaccggaaaacgtcgggaacgagttcgtttgttacttgatattcaggatggcaatcaatcgactaaccaaagcaatgctcaggatgccagcagcaccttacctgaagtacaaaattcagaaatgacaacagaagcgacattaagtgcaggagaaagtttattacttggcggatttatccaagataaagaaagttcaagtaaagatggtataccgctgttaagcgacattcctgttattggtagtttattctccagtacggtaaaacaaaaacatagtgttgttcgactctttttaattaaagcaaccccgataaaatctgcatctagcgaataataaatgaggctttatgagcaggaaatttagctctctagaggatatttatgatttctaccaggatggtggcacattagcgtcattaacaaatctgacacaacaagatctcaatgaccttcattcttatgcctatacagcatatcaatctggtgatgttataaccgcaagaaatctattccatttgctcacatatctggaacactggaattatgactacaccttatctctgggcttatgtcatcagcgtttatcaaatcatgaagatgcacaactgtgtttcgcacgctgtgcaactttagttatgcaagatcccagggcatcttattattctggaattagctacttactcgtcggaaataagaaaatggccaagaaagcctttaaggcttgtttaatgtggtgtaatgaaaaagaaaaatacactacatataaagaaaatattaaaaaattgttaggtaatacagagtaaaaactaccatcagctataccaatccccaggctgactggggattttctatcggaaataataaagctgctatagtgaagtgctcccaaagttgagcaccgaccactggtagatttatctacaggtgtggggttattccattaaccaggagtttatgccctgaactatcttctgctgtatttaatatcatttccgtttatgaaacaatcagtatatcttaacttagcattagaaatctgatctttccaatcatctatagctcagagtatatttgtcaggaaatgaccttcaaactttagccgagaaaaaggcttaccctggaaaacaaaacccttaaatatagctttatttttattcttctataaaatatactcaaaaaattacgtctaactctcctttttccgcctcatgatcatttcgttccagatattagactgtcccacaataccattaccaactcggtaggtttttctttttggtccggttgttccaggactttctatcggaaccgcctcaaggttaacatcataaatgaaaatctcaaggcgcttataatgcaaattaccataactaacatatctgacacgaaatgaaattttttcttttcttctcgatatataagttataataaatgatgctctcctcaggtttataccgaatgcttcggcaatatcattgcgagaaatccatttctcctgcaatttacaccaaagagaaaccaagatatacagaggttcaccatcgtaattctttactgagtcaggaattacatagtcgccatttttatttttagattccattttccatattctttttatttgataaataaatcgacataaaaaacatacataaaattattttaaataaacttgtggcattcctgtgtttttaataactaatggttctataaatttggcataaacatcaacaaacaatttttcatttcctcttacatggcaatgtaatgtgagattattatcattactcagtacttttttagggataactaattgataatcttgttcaatgtttagcaccgagggaatttcgtaattatatcgatggacatgaagtatgatgtcctcatcttcagagaggaccccctgatacacagaagcaatatcgccgccagtgatcatatttccatttttaatcagtataccttccccacaggagtcttcattgctaataaatataatgctatagatgccatccttcataatcataactcactcagtttcatactaacctcactcctttcaatttgttctatccataagcaatatcaagaataatggagacctttctttttctccagattgcaatgtaatatatcattaaatatactcatgtttcaacctgctgtttccctggttaacatatgtaatttctgattaataatattgagtaacaacgtaaaaatgaaaaaaataatactgagcatcattctcatttcaaattactgttatgcttccgattgttttgaaattacaggaaaagcatataacatagatccattaatattaaaagcaattgcatggaatgaatcaaaatgcaaaagcggaataaaaagcaaaacaaacaaaaacggaacgtatgatataggtataatgcaaattaattcatctcatttagatttattaagcaaatttaatatatctgaagatgatttattgaatgatgcctgtataaacatatctgttgctggttatatcttagcctctaacataaaatccagagggaatacatgggatgcagttggtgcgtataatgcaggttactttaatacaccaaatgcagtagaactcagaaggcaatacgcaatgaaaatatataaaacatataataaattaaagaataatgagcaaattatcgattaataatcaaggtctatcgcaatacgaatcaattgtgccacaggttcaaaaaagtcttctgttatatattgtcctttatgtatattcttatagagagttcttgctaaaggaatatcttcaatcactggaatatcatagagttcagccagtttaatgatctgtagagctttggcatcttttcctgtttcaataactaaaggtaatggagtctccccaagtttatagtataggcaaatcgcaatgtgagtcgggtttttaacaataacggttgattttttgatgttattagccaaacttccactttgtatctcggaatgaaggcgacggcgctcccctttaatttcagggttaccatcagtatccttggcttctcgtttcacctcatctttactcattttcattttcttcagtccctcatgcttctggaaccagaaatcaaatactgaaaagagtagatatccgaatagcacgcctttccataaaagaaaaacaaaaaaggcaacaacgacaagagcttgatatgcgttcagtcctgtgaaattagcaaactcatttgcatatgaatgccccataaaataaaaaatgagaacaattatcactaacttaaatactgatttaagtagctcaaaaatgctctttacagaaaaaatatttttcaggttattttttacactaatcttctgagccgatggttttattttttcaaccgcaaagatgaatcctatttgtgatacaccagtcgtaacagttccaacaaagacaatcaaagaaattggcaaaatatataataaaaatatatttaataccgcacctaatatttctcgaatggcatacaaaaacggtctatttagcgagtctattgtcgtattaactaatccaactatatcaacaaaaaaactcatgccatataaagaaaaaaatgaaaataagattaatgactgcactgcagccattacctcttcactttttgttacatcgcccttcttttttagatcccttagttttttgggtgtgggcttttctgttttttcactcattaatcatgctcggtaacgatctatcaattatgtcagaatgaatatttgccgtaataaaatcaggaaaaacatgaataactaatagcaatataaagattgctatcaaactttttactggcagtgataatgtgaatacgtttagctgaggtgctgttttgttaagaaacccaaaccccatatcacataagaatataccgataatcatgggaactgaaaatgataacatcagtttaataaatgaatcccatagagaaaacaaaaaatctattaaagcacgattgaatgcaatatcggcttgtaatggtaatatctcgtaggataaatatagcttatctaggatgctttgtatcccaccatgaataacaaagatcacagagataaattggtacaagataacgccagtgatagaagatgaatcacttatggacgggttaaaaattgaagatattgttgagcctcttagagtatcaataatctgtccagccgcatctattgcccaaaaaagaatagtaaatgataacccaatgaaaaaaccaatacttatttcttttagcgctattcctgtcaactgaaagattccagatggcaatttttccgaaaatgtatagttctctactatgatcggaagcgtaaacgcaatcataattgagttgcgaataaagttactgagtaaaacacctgttgaaaatattggtaggataataaacatccccagcggcctgagtatacaataaaatgatgatactatgaccgtcattatctcattcattagccgttcaccttcggaatcatttcaaatattatcgacgagaagttgatgattgttgttcccatccagtgataagtcagggcaagcgtagcaaacactgctattatttttagcaaaaaaggcaatgtttgatcctgtaactgcgttatagcctggaccagactaataataataccgataacagaggccgctatgactgtaggcaatgagaggataaatattatccagaacgtttgcacacataattgaacaaaatatccagtatccatcaattcaccaccaacagaaattcgaataatttttgccagcctccaacaagaatgaataataagatcttaaaaggaatcgaaattgttactggcgataccatcatcatacccaaggccaataagatattggaaatgatcaaatctatcgcaataaagggtaaatagagcaaaaaacctatcttgaatgcagcttcaagctgccccatcgtgaaagccggtaacagtataaatagagagtctttttttaagatagtttcattacccaattttttttgagctgcacgttcaaaaaactctacattgtctttctctgtatttttttctaaaaaaccgcgatatggtgataatattttctcatcaactttttgaaaaaaatcagagtcggtataattgattggttcctgagaaatattatcatttatctgtaatattatcggagacataataaacattgtcagtatcaaagacactgatgttagcgccatgtttggtggtacctgttgaatgcctaatgcgttcttcaatatccccagtacaatagaaattttcaggaatgaagtaccaataacaacaaatattggcagtaatgataacagaaaaaatacaataattaaaaatattggctgtgagccaatggtcattaattgagacatatcatcattcctgaataatgctaagataattatctttaaatgaattcaataaaatacttatttgctctaatgggtctaaagttattctaatatattcattttctattataattttattatgcggtgtgtttgcatcattaataagctgtatattgttggcctcgccaggatcaagtttaatgtctgggtttttagtgatcttaatagctccgacaatattgttattagatagagtttcccttacaacttcattaagtaaatcatcccaattaattcttgatgatgtatctaaagaatgtaatgcattagtcagtgacaaatgaatcttattcattatgtcctgcattaagaccaactcgatagcctggatatctttaacccattttatcgattggttaacctctttatctaattttattttattattttttcgaatcctttctctcattagaatcatttttctggcaattttttttctggattctgtctttaattctttcgatttcctcctcgccctcagtaaatgttcatatgttttttttcgagccagtttgataatatcatcagattgaataatttcctgtaacttatcctctggtatgatatcttctgtaagcactaaatcaatttttatatttttaaattcataaagtttcataaggcaataaaattttattaagtctgttaagaaataaatcattaatatgagttggttttatttctccacttttcggcaaaagatatttgactatggtccataaaggattatcagcaaatagccactccaaatttcctgcaccgtattttattaactcagcacaaaaccgttcttcaccatattctggtttacattgccctccctgccaatagaatgataactgcttcacattttgatatcctatctctctaatcagagtttctcgatataatcgtgagaaaatataatcagggcattgaatgtcaaataatgcactacttagagcaagcaatcttattttcccaattgactgatataaaaaaccttccttatttatgtcagataattccacaccagaaattttatcatgtatttcctgacgcaatatcttattgagttgattacgagtagaactagtttctcttaaacgccgaaaactgacctgattgacaccggttaaatcacctagccattcatcatgaaccatcatgattggataattaattaatttataatagttatagtctattttattaaaaattgtcatactatttttctattatttctattccgttgattcattgttgattggcttttagatcttgctggactcagtgtctctattagtttttcaatcttacttagggcagaatcatataattttcgctcttcaccatatgtgtacccctcaattaatttgtttaatttttctgccgcctgaggatctgtttttgctttttcacttaactcattaacgctttcttttacgacatcaaattcggcgattattttttttatcgcctcaatttctgatcttatttttttatctaatagttctttatttcttgtttggctcacaatactcatcctctatttattattaatcctgattcgcattatctctatagtcctaattgccgcatcacacgcaatgagcagttcctttgcttcattgtaggtaactttatccaaagggtgtttcattttttcatggatttcgttctttttgtcgtttattttttcaataaaaacatttgcggcttctttattttttattatttcatcttccagctcagttatcgttatcatttaattatttcatgttaaatatttttcagcggtattatttcttcttcagtgtccttcacaagaaaatcttctttcttcattccattcaacagtgcttctttaagccagcgtggctgtcggcctacgcccgaccaggtctgcccttcttcattgcggtagtaaacacctttcgatgagttccggcgagcgagtccatcatcaggcacattagtatatcccagctcttgtaaggttatattgtaataagtaatctgcttctgaatcgactcaattacactttgaacttcctgctctcgcagtcgctttgcttcctgctgtagaactgcaatttgctctataagctgaatgtatggacttgttgtatgtgaattattttccatattcataataaataatctccgcatgctttaatattttaagctattagcgaccttatcaggaaggaccaacaattaatcaaatgatataaattatgtgagataacgtttatctatcaaattaggacacatctatttcatcaaacaaccaccttaaaatgttattattctcttttttctaatgtgtaaaatacattatcattaaatgtcaacaaaaaaatcatatatttttaaaatccatttaaaatcaatgatatagaagaaaatcatctcgttaacaaacgactttaataattgcatttccatttagttaagcgtttctctttataagatagatctcattgcataaacaaataaaacagaataaaaaccaagctgaaccgtttcactatactctacttaattcgagttacaggaaggcggcaagcgagtgaatccccaggagcttacataagtaagtgattggggtaagcgaacgcagtcgcagcacatgcaacttgaagtatgacgagtatatatatctattagctgtttcccggacataagctacagccagcactaacctggaacgggtgcattataaaaaggaacaagggacaaatagctgaacagtaaccgcgttagtctcttcccgcataaccgtaccattcgtattaagaagtattgcccatatccattcggcgaaagaggatctgccatacatcaagtccgttttacttggcatcagatcatcgccgtcattaactctgttaaagtcggacaaacgattagcaagatctgtgattcaaaagtgcttagcgctaaggtgggactggttacagattcattaaccctgttctttgtcgcacctatcgatcggtgtaatgccacaacaggtttatgttaatcagaacaatgcgcccctctataaagagaattctttgataaggcaacttgaaaagggaaagctaactgatatcaatgtaccactttagtaatcatcacattatatacaggccaaaataagtttcctgaaagccagtatctctaaatcaatcattaatgatatattttatcgtcacaataaaaaattatctaaattctattacttatgtaaataagtacaaccttttcatagacacaaaaactatggctgacgcatcacttgcaatcaattatccatcattagattaatattttcacttatttttcagaaggtaaaaataactttctatgcgtttaaaacacccgctataaatatcttgtatattattgacactatatgatgctatatgatacttgttgccaaattgttcattacaaaccagataggagaatctctcatgataaatggacttaataatgactccgcatctttagttttagatgctgcaatgaaagttaattctgggtttaaaaaaagctgggatgagatgtcatgcgctgaaaagttatttaaagtacttagttttggtttatggaatccaacgtacagtcgtagtgaaagacaatcatttcaagagttgttaaccgttttagagcctgtatatccacttcccaatgaattaggcagagtatctgctcgtttttcagatggttcatccttaagaatttccgtcactaacagcgaacttgttgaagccgagattcgcacagcaaataatgaaaagattactgtgctcctggagtcaaacgaacaaaataggttattacaatctttacccatcgatcgccacatgccatacattcaggttcatcgtgccttatctgagatggacctgactgatactacctcaatgcgcaatctacttggttttacgtcaaaactatcaacaaccttgattcctcataatgctcaaacagatccgctttccgggcctacaccattcagctctatctttatggatacatgtcgaggactcggcaatgcaaagctttcactcaatggtgttgatatacctgcaaatgcacaaaaattgcttcgcgatgcactaggacttaaagacacacattcatcaccaacccggaatgttatagatcatggtatttctcgccatgatgcagagcaaatagcaagagaaagcagcggcagtgataaacagaaagctgaagttgtggaatttttatgccatccagaagcagcaacggccatatgctcggctttctatcaatctttcaatgtgccagccttaacgttgacacatgaaaggatctctaaagccagtgaatacaatgcggaaagatcattagatacacctaacgcttgcattaacatcagtatctctcaatcatcagatggaaacatttatgttaccagccatactggggttctgataatggcgccagaagaccgccccaacgagatgggcatgttgacgaacaggacttcttatgaagtgccgcaaggtgtgaaatgtataatcgatgaaatggtaagtgcgctacaaccaaggtatgccgcatctgaaacgtacttacaaaacacttaaaataaaactttattaatcaaaactaataatagaaaccacacccataattattaacaatttattccgaagttaatcacaattaaacaaagatatttattctgcaaacaatttacagcaaatagagaaaatgaaaagaaaaccattgattgcatttttcatcgcgatatttattgcactaaccatattaatattatttccatttaattgtacttacaaaaaatcacctcaagaacactcactttcatttataaaacaattaccaaatacggtgaacttatcatctcttacttataataaagaggatgatttcctgtatgccacccagaatagccctgcacagctacttaaaataaccaaaagtggcgacatcatggacagagccccactgccttttatctctgatgccgaaacaattgaacacatacaagggaacatttttgctgcagtagacgaaaagacttctgaactattcttttttacagttacaaaagatatgcatatctcctttcgaaataaaattcagttagaaaaattcaataaaaagaatagagggtttgaagggctggcatggaaagcagatgatcggatgctgtttgtcgcaaaagaaagacgcccaagtaaaatatttatatatcaactttctccagacctgctgagtgtaaagcaagcaactattccagaggcactaaatgatatacgtgttaacgatatatccggcctggcctttaataatgaaagtctgatgattctgtccgatgaatcgcgtaaattactcaagtttaacctgacagagatgtctttcattgagatgcttgacctgacaaaaggaaatcattctctgaccagtgatttgccccaacctgaaggaattgtaactctgcctgatgaaagcatttatgttgccagtgaacctgatatcctcgcgaaatttgtccctaataagtaagtctgtcactggccttattatttatcgaccaaacctggcaatctcataaagttataaaaatacgagtataatttcacgctaaataaacacattaatagttgaaaaggatatcagttattatcaaccagaatcttactcagtctattagtattatcagacttatattagatcctacaatatatttaatttgtatgcagaatagagtgttcacaccacatctggtatagaaaagcacaggctagcaaaaacctgaataaccccgtacttacggagttattcaggttaaaaatatccataacatcacttctgatttttattgcttacgacggatataatttctctggtcagctactaatatcatcatgctcacgcgtttaatcaaactcgtgtttctcaaacggacatcgcgggacaatcttctgcttctcccggcgcattttttaccaccttcgctacctgcattttgagcggaagatccgcttttttctggcccccgcacatatgcaagtccagttttaaatttatcctttatttcattctgaaacaaactgctcataattttctccagtggaacctgcatctcagggagacatcactacagaatacttccccttatgcactgatttaattttggtcatttagaataacggcctgtaaagtctcaatgcaacagatg

SEQ ID NO: 207 - DNA  (genomic)asmid), 840 bp; double-stranded, linear
gggaaaagctcgaggctgctcgaagaaataaaaatcataggacaaggtgatatgtattttcgcgattgtgttgggaacaagggataaagtattgcacttggtgatatactttaataacaggacctcaacgatatacgcgtgtttaaaaccaaatggtttgcaagggaagccaggtctcatgcaataacagatgaagagttgtgccgggccattttagaaacagaacaaggtaaagctgatgcacttggcggtggcgtttttaaaaagcgccttcaccaaaatcgtgagcgtgcaattattctggcgaaaggggtaagcaattggttttacacgtttttatatgcaaaacaggatatgtcgaacatcaatagtcaggaactggctgggtttcgtgaaattgcaaagcattatgccttcctgacgaaagcccaactaacagcaatgattaacactaaagaactgacagagatctgctatgactgcaaaaactaaatttaaaagtcctgcatttgaggctattcacagcgcagcggctggattgtccagcgtcaatgctatttctgctgaaacgatgcgtacttttgacaaagcctgcctgaccagcgtgcaagacttacaacctgttgagataaaagcactgcgggaaaaattaaaagtgagtcagcccgtcttcgctcactatctcaataccagcgtttcaactgtacaaaaatgggaaagtggcgctaaacgccccaatggcatttcattaaaactgctcagcattgtgcaaaaacacgggttggaggtgctgctgtaaatagaacgtagataatgcgttcacctactgtcagttccgat

SEQ ID NO: 208 - DNA  (genomic), 3357 bp; double-stranded, linear
tggatatggggtatgtattggcttaatgatgttgagcttatcgtcaaaacgcttacctgagaggtaagcgtttggtgcgtgttattgagaaaaagcgaattatttgtaggttgcaatcgtaatattgcctgagaaatttctccttagattgcggatatcattatcccttgcccaataatcatctttgtgtctataactctcatcggaatgtacatagggagaatcatcttcagcgtcgttatggataatattttcgcctttagtggtatagatataattagcaacatcaaaggtgtcattcgcgttatttacgactgcgcctaagacgcaaagggtttgagtgaatccgtattctgagaaatcgacatgctgatggtaatttctaccattcaaagcaacaaaactcggacaaacatctattgtatcgccaacagacgtagcggcgcgacgcacatcaagtgcagcgttatcgttagcaacatgaaatgcttgtgaacaggcataaaacaaatttctaatcccggtacgactggataaacaagaaataatttttgctattttttctggctttataccatcctgtactaaagaatctctcaccagatcacattcaccaggtgtgaaaacaactttcttgaatatttcctcataaacatcataagaaaaatattcagagagagtgaaagattcggtgggatgtgttaaatctgtaatttttttgctaagtaattcacttatagtgctgtttattttttcaccgcaacataaaacaaatgaacttccctccagaacttgcctttctgcatctacaaggagtgagctaaattcatcctcatgaagcttaagtttttttatacctgattgatgtaaatatttttctggaattaaatctttttgttcccttataagctctatcattcggcgttcggtttgcgtatcaaaagagtatttcatgttatagttatttttagcaacttccagcttaagagcatttgcagcaactgttaattctgagatttgatctttttcaaattgatcgtgatctgataataaccttataaactcttttacatttcgaccactaaaatccatatccctacactttttatcataacactttgtttcgccattgaactcacgatacagatcagtgattttaaatttattacttccggtctgatcaatttttatatagctattcatgcctgtaacggcaatctatgtcttataattcgcattctccgattcaggcgtaacatgaaaataaggaaccaatttatcactaatatcatgccgatagatatgaaatgaatctaaaagatataataaaaaacttcgaaaaatgtcacgaaaagtgtcatctttaaaccttgccctataattatcgagcaggccgctttgttctatcatattaaatttataaatattatcctcgagacttttgtcgatactctcccttagactctgattttgaaactggctattatcattctctgtttccgttggatatgaataactcgtcacactaaccatagtaacctcgcaatatgacactttgcatattttgacattgttagaagtatcaatggctagcatgataaatatctcaatgctaaccgctatatttcatttatttcaataataagactatagtgccgttaatttttatcgatttccccaatgcaattgcatcactaatactacttattcactatcaaaaatcgctcattttttcaaaaagactgtttacacacagacggttaacaatacgtgttcaccttaatgataaacgcgctttatcaagaaaaaatcataaatcagcagttgttgcggcaccggaaaatgtaaaatcgattttatcgcttttggatttttcttcgtcgacactaccggtagtaaaataacaagagcactgaagcttcacttcatttccaacattattaaccgccatcaaatacatcttctgactaaacccatttatagtaaaatcaatttctttaagatacttcccagtcccaaaaaaggcatttcctgacttttttaaacccgatgttgatgaaatggtaccattcaaactctttgagagtaactcgctaacatcttgagatgtattttttaaaaaactctgatagccttgcaaaggagaataataaaaacatgtaatcccctgagggttggataagcaagcggttatttcatcaatcttatcatccgtaatattaccgtttgattgttttaataattcccttacctgagcacaatcatcatcattaaagcaaaccagttcaaccatttgttcaagtgtgttttgactattctttggatctttttcaattatttcaattttgtctgtaaatattttaagaatatcttcacttaactcaacaccgcagcaagttattttagtagcacccttttgttgactttgttcttttatagttcaatgagcatccataatcatggaatcaaaaaaaacatcagttcttttaaaactttcctgaacaggtacatacccttcatcttttttaattcgcagttttaataaatcatatatattacttaaaattcctgcaggaatttcgtaattaaaatccgtattcttcataacaatactattaactaatttcttcctcaaaaccgtgtcagcggaatgtgtttctaacgcagaagttttttcagacaacgatttaataatagtcgctacagccactcctgaatatggaatttcttttcgtgaaggtttatctctgccaaccagtgtaatattaaaagacttatcacctgtttgtttgatttcgatatattcatcctctccagttgccgccacccaggtacgattaccattattttccgtgcctggcatagggtggaaatagtcaagaatatcggtgttaatactccgagaaccggacatgatgtttagtattaagcgctttatttcctgcaacatccattttgcgaaattactgccaggtgaatattttttctcgttatttttaatatcaagctcagcagcgacatttctatttttatccaaaaaggtggaagggcagagatttgccatcattattccgctgtttataggacttgccataatatacctcacgatgaaccattaattaatagaatgctggtcatgaccactggtatagacagcaatcagaatttaacaccatcgctgaaaattttagccctaactgtcccccccaggttaccggtgctgcgacttaaattaacgtcctgggctaataaattgtgcctgagatggtctctggcacaatttcaccctatatatctgcacggatctatcaaaaatcgctcatcagtaactcccccgagcggtttaatgtcgctcct

SEQ ID NO: 209 - DNA  (genomic), 508 bp; double-stranded, linear
ggtccgttgtgcccgaccagacacgggatctcgaccatagcttcatcatcaaagttatggattgccccgttgttaggcacaatcagcaacatccgctcctgagtgttgaaggcaattgccgccgccagatcgacgatgtatgacgcatgttcgtcaatttccagcttgcccgccgctgaatttcctgccgccgtaatggcgcggcaagcatcgaaaacctgtttctcgcgatgttccattacctcattcgcgcgagtatgttcagggttggaatgctgaacgacataatccgggaagagataatatttcagataggtgttcggcaatgtatccgggtccagtgcctggacatcccgcgcttttgcataggtgtcgttccagctcgcttcagtatgtgtatcttgctgcggtggaacataaccgtgcttagagacatattgccgcagctggtgcatcaggtcgttgccctgcaaatcttcaattgatgtccaccagccaaagtggttca

SEQ ID NO: 210 - DNA  (genomic), 2625 bp; double-stranded, linear
tcgtctaaatgatataaagggcactgtccgtcctgggggaaactaactatcagaacggaacagcgcttgtttttttatgagcatcctgcaccaaaactgcctttactactggctggagcgactttcaacatcttgcagtcctgtctttacagagaacgatattgctttagccgattaagctcctcttgcggaaagttaaattcgtctattgctttccagaatagttctttaaatacaggattgccatttgccttgcttattacatatttgccttcattattcttcgcttccagttgcatcatcacatctttaagataattttcattttcaccaaccacaattttgaatattttcagccagagacccatatatatcatccgctttctctaccgcaagagagaatgacttcccatcaaagtcacgggtaaactgctccaaaatctcatcgaaagtgaacccgtgttgcaacgccaggcgaatcgccgcattcagatatacatcaatgacctgcttactcattgtcttatagctggcaacatacaaagagcaaactgcattatttctgctcagcgacaggagttctctcactacatctttatcattttcataatggctggctatcacttcagctgtctccatccaggcagcaacaatcttcgtatgccctttcactatcgcagaatataagcctgatgccttcgtccatttgtctgatgctcccgccactttttctcttgctgccatcagtttcaatatatcttctttatttaattcatttttaaacattttggcttttatattggctagcaatatattaacaacattataatcattggttctaatagcgctatttaaatcatcaattgagtctatttcctttcctatacgaagaagtatttcatttttatttaccccaaattctttctcaaagtcatctatcgccaacaaccatgctttgacaattttattttgattatttttcaaagccctgggaatccagctcactccgagattatctttcgcaaggagtagagtttccaggtcctcttggctaaaattatattttctggtcaactcttttaaatttgttatgtaatcattaaacttatcaatagtattgtgatacaataatacacataacccatatattccttcaggtgatttcgcagcaagaatatcaagagcctttgatgctgtcatttcttgagagttttttaatttatcgaaaaaaagaacaatgtttttatatatccccattctcattaatagaaataatgctggtggtgataatggaggttgcaactcattttcaataccacttaataaatgggcttgttcccgagggagataaggggttattcctacacactcggagcaaatatctgttattacccatttttgttttgcctgttgaatatttataaacgattgcaatgacccaaaagaatcacagttgtttgctttatagcgtactgcagtattggttgcattaggatcataaaaggatacaacatattctgtttcaccagcaggcgtttttttgatcctcaagcggacggccatagcgtgtgtttgagattgaacgattgccgtcatatgcgttaacttctctttttccattctgtgaaaaaagacagataatgcctccccaaacttatcactggcaacgacgcatgtaccgggtggtggatttttttgtagattgttaaattgctgctcaagctcgaaaggaatatgtttttgtatatcttccggagatgaatagtaagcctttaatggaactttccctgtatgctcattcattgaatctatacagtattgcagagcaaaatgtctacattctattaaactttttggttttccagtaaaatgcaacaggcaattataatctacaatatcatatttgctattagcttttatctgctcttttgtaaaactctcatcatcagggtacgtatgaaggcaagtaaaaatatcatccaggaattttataagcactggagatacggaaatatgtactatattgattgcgtctgcatcgcttacggttaaaatcataccttcaggttgttgcttagatctggagacaagaattgaatatgcaccatcgctatagaaacctaactcaacttcagaacaatgattaacaaaatgatttaacggcccctctttttcaagtgaataaactgaaggacttttaagatacgcaactatatcgtcaacgaataattgagatttatttttttctccatccaaatcaggcacgaaagaaggagattgtatacatactctgctaacagttacgttatcaaccattttctttcccctcatccatatgaaagttgtagtaataataaggttactatttaaaaatcaactatcaaatttcgctcatttatagagttatttgtctttttacgtcatttccccatcaggtcatcaacctggtaatgaggtgggtaaaccgcgacatcaacgaggggaacagctccttgtaatggtatccctataatcaatatcatcatcttcaacaataattataaaaattaaaaaaattatccattcacgtatttttgttaatattctttatgtgtcagttctcataaacacagccaataactaaat

SEQ ID NO: 211 - DNA  (genomic), 27 bp; double-stranded, linear
aacgaattgctggcgagcattaacgtg

SEQ ID NO: 212 - DNA  (genomic), 7425 bp; double-stranded, linear
tcgcctccttacttcaacacttacacatcagtcacgctggtttgagatacagaacaccaggtgtctgatgagtaagcgtctattccctatgaataatttatgtcgttattcgtcctgtcatccaccctctgtatggttaagcctgggttatattttgtacaatatcgggataccgttcgaaccaatccagaatattacgcatcgcgtcactgatgtttttatcgtctttatattgattctcaagtctattatttcgaacaatagtaagcttagaacgtattttatcatcacaatcgacaattttcgcattcaatgcatttacttcatcctgcacttctatactattccaattgtcccttttgttatcaaataaagtccttttatcctctaatgatttattacgacttatgattaactctttaatttctcgcaataagtcatcgtaatctttaatggaagctcttatttcctgatagttttttagtaaatcctcccagttaattgcaaatgcactggaaaaatagtaaaaatcgcgagcatacttattgagccttgagtcgtaatctgtcttaaacgattttatatgttccagttggtttgatagtgctttaatttgtttttcttcaacaccttcaaaaatgggtgcaagttccttataatcaaatgttacatttgtagcagattctttatgagactcctttatttgcttttggacatattcttttggattttcagtaagtattgttccatctggcggcggaatcattttatttattatagattcaacaaacttaatccggtcactttctatcatattgttaatgatattttgtgcattttcctgcatatctttaaaaataaaaaactcaaccctactattatcaaaatgatatttttcctcgtacgatttattttcaacataaagtgttgataaaaacgactctaactctaaaaatgcgtttttatatttttccttagtctttgactcggaattataaaaatttattacatcgatattgatagcacttaccttttttaagaaatcaggtatttgttctttacttatagctccgtccagatccatatacatgtatttttgcgctgtaagaccatcttttgaataatttgtatttggatcaatagcacagtctttgcacctatctccactgtaataatagcctaaatttgccccaatcaaattactatttttaaagaagacattattgttctctgtatttttcttgctaaatgaagaatcggtccctttctttatactctctacgcatttcgaaaaattatcatctaacttaagatttctcgatcttctttcaatgtaatcagaaaaatactctttggggttaaacatagttctatctgaaccatcttcacgaagaccatcgtttattttaatatgcttcaaattacaattataaaacacagtccccgtatccggacccctgatttcatcataattagacttgttgaacgaatttgccaaaaaatccattccatgagcatcaagccctattatattacagttataaaaatgactcagaagtatactcgagccaggacaacatcctccctggattatacaatcctgaacgaaagactgcataaagagataagaacctaatttttcttgaatactatcaggttgtgtaacggtgtagattttagacgtctcacatctataattttcaattttgcatttagaaataaaacaacctttaaacataccttttattggttttttatttcctgattccacagtatcatcattagtctcataaagctgtatgttgttgaatttacaatcatcgaaatagcaattttcaaaaaccggaccttcaaggttagggctgtttatcactcctgaaaaaattacattcttaaaactacaatattttaatgaatttaaaacatccttagacaacgatgataaattgattgttgtattaataataggaattttatttttaatcagcgtcgcaagttttacagaataattatcaaacgttaatctcaccaagggagaattatcaaaatgtaaatcatcgagataattatcaagcgttaatctctctgaagaaacctgttttttttcgttatcattcgaagtagcccccgtgtagagattaaaggatctactcacaataacttcattattttcatttgtggtaaagtctgtcttagtactaaatcgccattgttgttctttttttgccagagatttaatcttatcgaacacctcggctttattatcaactttcgtgacaaattcgtaaattaagcctttgacttctttaatatgagagccaggaaaaagatcgcgaacaaactcccacagtgtacgttttttaaataaatcccctttgccatcaagaatattttcaatatccttagagtttacattatatttcttatcattaatacttaaagcaattttatcagaatagcctttatgactaagcctctccttatacattgcttctaaaaaaggattagtattaacaaaaacatctggttttaatttagcgaccataaatcctccggcgtgtaatattgagttgtttgaaaaacaataacttctatgttgttaattaactgtactgctagttaggttagcaacaagtgttacttatattaccggtgaatactgtaaaaaatagctcattatttccattttaacccagggtgttcaccctggatttgcaattttttgggggttaacggtacattccacgggttaaccgcagcatcagaaaatgagcgtttttttatagccgcttttattgtcgaggttaaaataaagagattttattaaattttatcaaggtgatttatggataatcttattggcacaccaccaaaccacgcagttccccataactatatagacatggagcaaatggaatatttatgtcatctcaatcgtttttctaaattgtctaacgattttttaataaatggtccaagagaggacctttttacatataaatatgttttagatggttcattttcaaatttacagcatttacttcctaaaggacaactacagaagatacaacagagattaagttctcttatgcataaaaacatgtttcattgttttcatgtttttttattaaaactatgctcaattgagagtattcctctcccaaatgccgattacgctttctttgatgacgaaatgccatttacattaactgatgaacagatcgaaaatatttcttttttaaacgcatatcacaaagaaaagaaaggaaacaacgacattgttacatttgatttcatgagcgctgatcaccactataattttagcacaaccatagctttaacaaatgatagcttccatatatcttcaataaacaaccataactcacaggttatattcgatgaaaacatccatttacatccctatgaattaccagaatcatcacaatggtgttatcagttaataaaaaacatgatttctttacattgcagatataataacaatttcaagataaactaaaccttttgttttgattttaaaaataaatctttttgtaatgccaggttgcaatatataacgtttattgcatgttttttttcacatgaaaacatgaaatattcgacatttcatgatattaaccttgatatgtgtgagataaagaattgcaattttaacaattcagagatgaatttcatttcgtgcgtcgggacaaattttagcggttctacatttaacaatgtaaaaacaacaacagcgcaactaattaagacaccaacaaagtggacgaataatactctaaaatattggttctccagttgtaataaacgtaatatcatcttcacttttaatacaatatctgatagaaatatgaaattaaaaggtatcaaggatatattactgtcgttggttgaccaaaaagtcaatatttatagtgtaaggcaagagcttctgaattttcttaataatgatttatataaaaatgatggagagattctctcttataaagaatcaataatgttgttttgtgctgaatagccgaaattagattattcagattaactaccgcactctatgttgtgtttatatccatgtaaggaaacaggtcatttgtgaatcctgacaccagactatgactatcgcccagggataatccacaaccgctggaagcagtctcttttcagttggataaaaccgtaaagtgcgattgcgataaataataaatacaggcttattattccagtcttttttattgcgttggttgattcaaatggctcggttagtaaaatgcaccattcactcggaaaactcaacatgttgcactcttatacgccgtatggaaaagacgtaggagtggtataaccatttaatcgtctcccaacgtcaacgcttacacatcagcgacactggtttaattaaagcataccagatttctgatgagtaagcgtcttttcgtataacctcattgtcataggaacgacttgatccgtttatttattcgccatgttattcagtatcaattttcttaatagctttcaccatattttgattttcttttagccaagtcctgatattttgaactacatcattaagtgtattctcttgttgatactttatcttgaacctctctgtttcagaggaaagatcccggattgcattatctatttcttcaatttttttatctattttctttatatcattttcgattttgactttttcatcattatcatttaaattaagcatcttctcattaaaataaacctttctttctagctgagcatctcttgtgccagaaaggttggctaaatcttgaaatttataagtgaaattttcattaatataattattatttctatcaatgccccccaataaatattgttcaatgtcaaagaatgaagcaatttcatgggctacatttgctggtttttctatatatttctcttggtttattttttcttctgccttaaagtttttcaccgttaaaaaaagattttgcttttccaaaaatttctcctttgtaggcttattcttattctcataatcgtagtaaagtacttgcaaaccagcaaaatcaaagtaaaatctattaccatttggattggcagtacgatatgttttttcatttccattttcatcgtaatgtctataccaataaaggttattatagattttatgcatgaaattcactttatcagtatctatttcactagctatatctttttttctattgtacaaaacattatctataatatattttatagtttcatcattgagttgaaaatcttttacatcataaccaggcataatgttatgcagattaactaataaggattgtaaatcggctagtgcctttttgtaattattcttcatattattgctatatttataaatatcttctatccgtgaataaatattcgttaccttttccatgaaaggtaaaatgtctttttcagctatagctcctctatggtacatataaacaggaattttaacctgagtgtttgcagcaagattaccacttaagatagtggtatgagtatcaatagcacaatcatacaagggattcccaccggttaactcgcccaaacaagcagcatataaacagcaatgattaagatttaaatgtttatctatatcgtcttttatattataatgagttttaatattttggaaaatatcatcgtggataaaatttaaaagagctttatccagattaagtttatttttattttcactttctccgaaatattttcttggatcataatctcgtaaatcttcacgaattccatctcgtttgcatgtcatattaacataacgaaaatcacaatcataaaaattattactatctctaaaaccaccgcgagtttttccataaaacgaagtttctatgaaatccattccaacaccattaagctttgctatattgcaagataataaactgcttgcaataacacttgcttctttacacactccatcttgaagattacttgcatatacaaatgactgcataaacagatatgcaccgactttcttatcccctctttggggatcttgatttatagagtatatttttgatgtctctatcttgaaatttttcatttcgcattgatacaaaaaacaccctttaaacataccgtaaatcggtattttattatttggttttacgttacaaagaacgtcatagctttcacaggtcactttatcaaagccaacaagggacacactctcgaaattacattcctcaaaaaaacaattttcaaatactgggccattaagattttcgtaagatatattacctgtgaatgtcatctttttaaagcaacactgttttagcgataccagaacatcttttttcagtgcagataaatcgattatcatattttcaaaggggattttattttttaaatatacgcttagtttttcattatcattagggaactgcattttcaatatccctgattgaaaagccttctcatcaaaatgaatatcatgtttataactattataattgcgttcttctgataatacagaacgcattgtattttcttcagcattattatgattatctttcgagttaatatttattttaaatactctactaacaataatgtctttattctcatctactgtaaattctgtcgtcgtactaaagcgccatttttcttctggaatagcgagagatttaattctctcaaatctcttaactttgtcctcagttttcgttacaaattctacaattgtttctttagcctccttaatatgatacatgggaaagagatcgagtataaattcccaaagagttagtttaagaaaagattgtctatcaccagctataaggtttgttatatctttatgggttattgaatacttctcctcattaccaacagacaaacaaaatttttctgatttttttgcaatccattattttcatctggcattttagtcagattagcaaatttatctgtaactgtactatatgatgatatagccataatcatttctcctgaacacaatatttattcgcccgagcataatacattgccgatttgtcttaaaaagcatacctgggtgttggtttgctacgattatgactaaaccacctatgaatactgtaaaaaatcgctcattttttatgtctcgatatagggcttttaccctgttttttgttttcttttccattctctgtgcaggtagcgatataaatgaaaagaataacaaatatgtttttatagcgaggcactacattaaaagtaaaataattcaaatgaaataatgtatattcaatgtactggggagagtttcgaggtgagtttgtgtggcaatatttcagtgagaaagtgtatcagcccggtaactatgtatgaccgggctgattgccagatgcggcaaaaagctttatctggcctacagttagcactactctttggggt

SEQ ID NO: 213 - DNA  (genomic), 6943 bp; double-stranded, linear
ccaaaggaaagttattacttattgatattgaaggggaaaaatatcagcattttttcatgaaaggagaggaaatatgaacggctgtcataaaacagccgcaaaaggttagtttacaaattcaatggttaaggtcgcggtagcgttaaaaacgccgggctgaggccgggcaccggtaaagctggcaggtgctgccgaaaaagttaccgaaccatttttacgaccaaaaatggtcgtgttgcccatgtctgcgggtaacttgccgttgttgacgctaacttcagcattcgatttattgtaaattttgatcccgacatcagcattgtctgtcgccaccatcgtatcgtcactgcttcggttcgtccccgtaaaagaagcatcgactttctgcgtacgctcataccccatccccgtacactcaatactcactgttttagtgatttttcgtgaagtaatggcttgcccggcggtagatgaaaattcggacgcaggaatagtatcaaaatcaaaataaatcacctgtcctgcatttatctgacaagactgtggtgcggtcaaactgcctgaaattcgaacttttgcaatcgcctcaccacgggtcgtggtgctggatatgttggcatacagcaatgcaatatcggtgataggtattactaccgttccatttattgaacgtttaatacgaaatgaaatcttcgcatctgctccagttttcaggctcacgccaaccgctgtagttttgtttccctgacaagtgtgatctgttgtagttgcctggttggaaacatgttcaaaaggaactgccgtataccccgcatttagcacagatatttttgttcccacatcgacatattcgttaagatagtaaaaagcaagaccacttgcggtggtgctataaaccataccgggagcagggtctgcggtataatatatttcgtgataagcgccattgctatgttttgaatcacagttacacagaacgctataattttcagaagatgttgcattagcaatatctattaatgtatttccaggcacattgtttgctgcactgaccgttgtcagaggaaaattaaggcttaatgtatgtgtgccgcctcttgttgcacacgtgccatcatttgccgcatacccgcacggtaaccctaaatgaaagagaattatgcaaaatatataatgccattttttcatgaaattattccttttactaacacaagattagttagtaaattcaataaccagcgtggctgtagcggtaaatccattatcaggcgctggttttgcgcccgtcagactggcgggcgctgaataaaacgttacgctaccatcggtttttcctaatcgactaatagcacccatatcagcgggtaagttgcccccatccacattcactggacggtcgttcttatcaaaaatcttaattcccacatccggattactcgtcacgatcatggtggcatcggcacttctgtttgccgcaatcatcgacgcactcaccacctccgtggaccttacgtcttccatcccggtacaggatactgtgacttcggttttaatctttctttctgcaataattgaacccgccgttgaggagaactcagcgctattaattttttgaaaatcgacatcgatgctctgatttggcgttaactcacagttctgcggggccgttagttgtccgcgaattgtcactttagaaacgggggtcgttttgggaaaatgatcggacatgcccgcgtacaaccaggcgacttccgttgtgggtattgtcaccgtgccagtaatagaatgccgaacatagaaagataattttgccgagcgccctgaatccagatttacagtgctcccattattacctgctccacaggtatgttgcggtgaggtggattggttggataagtgttcaaaaggaatggccgcatattggttattaataataaaaatcgtcacgccgaccgataaataatcattcagagcatagtaatttaacccattaagagtgcgctcaagcacaagccccggtgcggcatctcccgtgtagaagataggaaaaaatgctgtttgttggcccggtccgccatgcgtgtcatcacagtgacagcgcaccgggtatgttccagtcgtgttgctcagtgcctcgaaaatattgtatccggagtggttattcgccgctgccaccgtcagcggaccaaatgataaatttgacatgtgcgttgcgccatcaccattagcggcgaaaccataaggacagcaaagcagcagaatcaaccctgataatatttttttcattcatgcttcctttagcgacaaatcgcatccatttgaaccaggctggtatcatcaggtttatgggtgatgtgataggccgccttacatttttcatccgcagcttgtccccaactcaataaaaactcgcctttttcaggcatcccggagagatacagttcgccgttatcaccgacaatcccggtgactgtgcccgtttcgagagaggcggttgccatcgcgccaaacattattggtttaccgttgacctggcggacgttaaatagcacgcgataaccgacatgggtgacaaattcggctttcaccaccgcaccgcgcgttggtaccaggttgatgacggtgttttccagttcaatattggctttggagaaatagtcgctgttcaatgccacgcggttttcgtcatacgggctaagctgcgtttttacggtataaccacgccagtcggtagaaatcccggtggcgttttcaatggacaggccttctgcgcccggcgctttgaccaatgccaccgtttcgcccagttcctgcgagaaggtcactccgtcactatgcaccagcacgccgcctctggcgccataatcaaaatgttgggagtcacggctccaggaatagctaccattgaccgagccataagtcccgtcataggtcattccggcattgccgctgtaggagtcatcaggagagtgcatccacgattcctgtacgttataagacaggttacgcccttccagcatcgttccgttcagaccgacctgcatcgtgctttcatggtggttgttttgcgttaacgaatagttgacgtagctgtcttccatccagcacgatagcggtatcgacattgagaacatgaaaatctgttctttgccgaaatcatcattgttatcatcatgatggttgcccaatgagcgcttgatcgagtccgtatagttccaggaaacgttccaggagatgtttcgccagttgttgttatagccgaactgtaataaacgttcgacctcatcggtctgccagtattcctgtcgactgaatgttaaataaatattgccccagcctggcgtgaaagattgcgtccaggtgccttcgaagcggctgcgacggttgcccgttacccagaaatcagaatcattatcctgtcgcgacacccattcattgagggtgtagaacccctccatagagtagcgataacccaccagacgaaaggtggtattggtgtcttcaaaacgtttggaatagagaaaacgatacgattgaccactctcattatcgtcgtagtcaaactgcgagcgggcatgagtcacgtcaaaagaaatcgcgcccagcgcccccatatctttaccaatacccagcgcggcagaagcgtaatcatttgccaattgtgttccgccatacaaagttattcccaaagggaaaccgtgcattgcttgtaactgcaagacctcaggcgtaaagccgctttcgtcgcgcacttctccaatgctaaggtctacatcggtctgaccttcacgcttgagaatggccagtgaagtaaatggctgaataaagtgctgctcgctgccatcttcttctttgatagtgacatcgagatcgccgccgctactggtcgtgtttaagtcggtgagggcaaatgcgccctgtggtacggctgattgataaataacgtagccgttttgtttgatgatcaccgtggcgttagttttcgcaatcccatgtaccactggcgcaaagccgttctggctggagggcaacatatcgtcatcggtatacagccgcacgccacgcacctgtgtactatcaaatacatcgcttgccgtccaggtatcgccaatcataatctggctacgtaatgccatgatgtcgcgctgaatgtaattactgacggaatggtagtccacattaccgtcataagaattcagggtgctgtaattacgaaaacgccatgcgcctaaattaataccattacgcaaattcagataataactgtcatcgtcgtcgtcataatttgaccggatggtatgcgatgccgaaaaatcataattcatcatcatggcattgatcccctgatcccaacgggaagggctgatataaccattaactgcattgttgagataaatttgcggaatagtaatattcaatgcaagtttactggcgtccagtaaccaggtagccccgtcgatcagcggaactggatttacgcatgttttgtcatcaacattcgccagagattttatcgcatcaacttttataccataggtcgccagcacgttttttatcgccacgtagcatgggtggagttcagcatcagggttatcctgggcgaatttaacttcctggcgttcgaagagcatgccgttgatcatcacatcaactttgtatgttcccgcaggtaaggtattcgaacggttgaactggtgaatatcaatattatccgcaggatgatccagttccagtaatctggggttgaacaagctatcccgggcaaaagcagatatggaacagagcagacatatgcccgatgcaagcgtaatgaaaagatgcgaagaggccatcgatatatccttatccggcgcttaaaggtttttctttagtggttgactaattgcaccgtaatcattaataaagcgccaaacgagcgattttcctgccacgccagccggaattggtaatgtcaatatttcaaaagggcggatcatatttagcgacacgtctttatcatccaccgtcacactcattacattaatatggatcggatttggattttcgacgatgagattattaccctgccgcgaccatttaacatttttaatagcctgctcagggattatctttaccgcggctggtcgccagaataacttaattcttgtttttatggctatctcaagaacattggtatttttttatcaattgaaggagggatgtttttcacgttcaaccagaatacggactcccgatcttttggtaactcgccagccgtttttaaaatgcgtaatattttctcttgctgtggttcaatgcgagaaacgggaggtatcacagaaaatggcggtttgcttttatcctctttattaaatggatcaacccatgtctgcaatagatagggaaggttcgtttctttattaaaaatagagattgtggtatcaggtttgtcaccataaaaaataacgcgagttcccccaacaacaataccagccgtagccatcgacatctgcgtaatcaaagtaacagcaaaaaacaatctaagtaaatacataggcataaatgtatctcataaaaaatataataatgacgcccttcatttaagtaaaagagaaccataatggcgagcgccattttatttaaggtattatgttaagaatgatttattttatatattcaactgtaaactgcgagtcggcgttagctgtaccagggtcaatagtcgtttccgtagcaatataacgagccatgaacttcatggatgcattaccattagaaatcggagttgatgcagaattttcatataacttgacctgagtgttatctgcacggttatataaacgaatagctacgcctttcgctgcactaacggcacccgcaccagtataatccccactgttatcactcgggctaataccagcggcagcatcgttagagttatccagcggggtaccaattgccaggttgccattaccatgagcatcttcattaccatcgaaacgaattgcggcggacttaaaggtttccgggcattgagtcagatcgatagaaaaagccgtcggggcagccacatcatcgacgccactaaaggctgtacggtttactttgcctaaatcaacgacctgatctttagtttcaggagtgacttcgcaagtactgtcaataatttcaccacggaaatggactgttccatcagccgcctgtaggtgacctgccataaacacagaagttaacgctaatgctcctacaatcatatttggtttcataaatataactccattaatttgatattattcctgtgtgttatccatttattaaatttggataaacctgatcggtatttgatcagaaaccaaatagtactaccaatatactttggcgcaagtggtttttattttatacatttagataaattaatttaggtgttaagcaaaactaaatttatatcgttatgtgattgcttaaaagaagagggaataataaatggatataaatattatttttatgatgaggtgattttttaattatatcacacatctcaaagcagacaattttttcatatttacataatccacaactatgaattcgcgtagaaaacagtcttatttttagtaaaccacactttcaaattatattttttgcctatatttgtggaaagactatacatttacagtgataatttattatcacacattgttacatagttaaataaaattacatattgatgattgttttacaagcgattcttgaatgaacaaaacgtgctattcattacaaagtacatcaattatggcaattgtttgtcaatgattcgaggtatttaattactactacggttaaaacaagtgttcaacggtgccccaaataatagctgaagttaattatatggaatgaggttagattattaatgctggtaagtaaaagggccgccaaaaggcagcccttcgttcagcaaatgaataat

SEQ ID NO: 214 - DNA  (genomic), 1003 bp; double-stranded, linear
catccggcatcagcaccttacttatcacatttcttcacatcaatattccagtcagcaccagacgcaacctgatgtttctgcgcgaaattatccatattcagcgccacggaaacattcaataagctgttcagatacaccatcggctgtccttccggcacatcgccgaagcttgcgacatacggcattttccctgcgtatttttgccgggaaccttcggaaatggtcacacacaacgtgtcgttgagtttgatccccgcctgattcagcaactcgtcgctgatattgctccagacgttgccgtactgaatatcgagaatcgggatattgcccttcacttcaccttttgttgcttttgctttctgataagaaagttcgacaacctttgcaggaagctcaggccccacctgctcgaacgtgatcgccccggaagccagacgtgcaccggtgtaggcatacacgtcacgaccgtggaaggtatatgacttttcagaacctttcaggcggttagctttttcgtcgatttcccggacgctctcaatacccagcgattccgccaccaaagtgagcgtaccgttatccggtgaaacgaagtattgaccgtttttggttttcagcactatcgatttacggtcagtgcctacgcccggatcgaccacactgacaaataccgaaccttgcggccagtaactggcggtctgatacaggcggtaagcgccttcccagatgttatacggtggaatttcgtgtgttaaatcaaatattttaagattatggtcaacaccgaatgcgacccctttcatcgccgagacggcaccatctttcaggctaaaatcagtttgtaaaatcaaagcgttatccgcataagcggatgatgatcccagacacgttaataaaaataacgttgcgagcgtttttttcatttttgtttcccttcatttatctgatgattttccagctgtgtagccagccccagtttgtctggcctcctcgagtgtacaatgct

SEQ ID NO: 215 - DNA  (genomic), 2692 bp; double-stranded, linear
atgagtgccggataaagctatttttttatccggcttatttctaaaaattgtcttttttaaagttatgcggattgaaaacttgctctattttattttcttgtgttaattgatactcagtaaaatcgttaataccaatatgagtgttacgataagggtattcattaataaccattaagtaatttttcgtgatgcaattatcattgctcttaattgtcgggaaacagtagagatcttcatacggcccttcgatatattttttatagtcagtgaagccattaccgatatcaatgacataccaggtatgccaactaccttctggtaggggatgttgatttttaatttcattctgatgcttcagataccaatttattttatcgctgtcagtccatggcagatgatcaacgaccagaaagactgaattgccagcatcagagtatgtatacaaaatctgtacaggacgcaatgtccataaattatagatgcagcatagaagaaataaacataatataattttttggagtttgcttttcatagataattttcgattctttcgatagtgttaaaattggtgaaaaaaggtttgaaagcaaagtctttatgccgttgtaaaaagaaccatatgcgaaaaaatctatatttgctgtaagtcttgtttttgatatcagttacatcaagaccgaagtggtcctgtgctacaaaatgaattgttgcactccatcctatagcgtatttttgaaaacttaaaagagatattttttgagctgaaatatcatgaacactgattcctaagccattaaaactgtcctcgaagtcattaaatttatttagtcttgatgaaagtaatttggttttaatgctttgcaggataagaggttggtatcctgtcgagggagttgaattaatgccattttcgatacattctttgattattcgtattggactattataaccatatttatttattttttcatgaaaagataaatttaattgttggctatgaaaattgctgccatttccatatctaaaatgttcaatcagatcttcgataagtgttttatattgtccaaaaaaggaaaacatttttgctagttctttcatttctgcaaataaaatatcagtgcattcacgttgtgatatttttgttccggaacttgaggcactaaaagcaacattaatagaacctgggccagggaaatggtatttaataagtctgtaaggatcaacttttgctgagatatcgcttaggccgagtgagagaaaatcttgttctaccatatcaccatattgcatatcatcagcagaataattatcaaataaactaatagtttcgaaaagtgtacagggaatattaattgatggaagtaatgtgttattcatttacattttccttggttatatttaagctcaatatcaatttgagaacaaatgctagggtaaaaaaatatttaaaaaagaagtacacttcacattttttcattacatctctgaagagaacgtcgttaatgattggtcttgctcattgttaataacaaaatattgaatttaccgattaggaaactttttcctacgccgattgcctccagctatggcatgaactttgagtttatgccagaactgaagtggagtttcggctacccaggcgcgattatctttatgatcctcgcgggcctggcaccgtatctgtactttaagcgcaagaactggctgtaactatacgatgtcgctgtgagtaagttagtgtgctgacagcgacattttagcagagggaatcgcagataacataattgttgtgaataatatccatgccacgttgagttggacgcttaatgactcacatctcaccccttcaattgctgcagagataatagaaaaaagtgtcaaacccaatgaaatcaatacaaagtagattgccttacatccagtatctcttattctttttgctccaatattgatatttacataggtattattaataaccagaataaaactcaaagccaggttgatatcattcaaagttattaatattgaccatgatgttaatgtatagattatgaactgaaagcgtgataaacgctcaagcttggatgggtagaatatatttctgatggatgatttgaacattttttacattgttttatatatataattgttttgaatatatattacctgaattatgtggtttgcatatatatatgcaatatagcagtctttgcattgataactatacagtagtaatttagagtgtgtaagtttttattgatggggtatattttaattaaatataattggaatgtatttttattctataaacaatatcttgggtgaatggattctatatgggaaatggtaacttttggcagttgttcttgggtaaagaacccttacagcaaaaaatctgattttgttaaggcatggttattgtggtgggctattaccatccttgttctatttattttaagcctgactacgacattaaatttaagaagtataggtatagggttaagttttgggttttgtcaaatccttggtagatatacgatgtctctaggatggagtaagtactggggagttttggggggatttcctgtaacaaatattgttctttttcttatcttaatttttttcaaaaaaagataaataagtcagtgggtaggctctttaaacggcctacccatgttaattcttaactttt

SEQ ID NO: 216 - DNA  (genomic), 48 bp; double-stranded, linear
ggtggcgaagaaactgggctacagcctgaaggattgtattgcgtttgg

SEQ ID NO: 217 - DNA  (genomic), 38 bp; double-stranded, linear
cgccacctcgcgacagtgagctgaaagccgcgtcgcaa

SEQ ID NO: 218 - DNA  (genomic), 34 bp; double-stranded, linear
tgaacaaagagcacttcatcagcaatctgaaact

SEQ ID NO: 219 - DNA  (genomic), 48 bp; double-stranded, linear
aaagtttccacggcaactaaatcccggcgttgttgcgccgggtagtac

SEQ ID NO: 220 - DNA  (genomic), 989 bp; double-stranded, linear
taaagaatgtgtgcggatataaatttaaacccgcataagtgattatttacttgcttcagcctgacggattgccgccacttttttaccaaataccagttgcagtataactaacaaggtaaacggaggtagaagtgcggcagcggcgggaattcccagcgcgccttttatcaacatggaaccggaggcaatcagcaataaaaagaccatcacacggaacactttgactgaaatacgtttatgcacatattgtccaaccagtgaaccgaggatcatggtgggaatacaaaacagcaccagtttaaagatcgaaacagtcaaaattccgctggtcgccagcccgccgatcaccgcgatgttgtttgcggtgaagaaagcgttcagagtgccacgaaatgccgccgggcctaagttacgcagcataccgtagataaccatcggtggtccgttggttgagaaagctgcgcctaatgcgcctgctactgcaccgataggtgcggcgatccagctacggtcataaatcggcaggcgtggaataaacatactgtaaaaggagtacaggataaggaatccgcctaagcccactttcataaaatggtcgggtaaatacgacagtgcatataaaccgacgggtattcccagaaacgagaaaataatcagtaccattgccgatcgccaatccgtttctttacgtgacagccaggtggcgtacaaggcggtcgcggtgccgacaattaccgagagtggtgttgccatttttacggggagcattaacgtgacgagcggcatagtggttaaaccaccgccaaatcccgcgcatatccccacaaaggtataaagaaacattaacgcgataacgatacataccacgtttgtttccagcatgaccccatccggtgaaaataacgtaaaaaagtccataatatttcctgttgtgtaaatacaactctaaacaatgatctcgttcttttcttaataaaattaattgtgtt

SEQ ID NO: 221 - DNA  (genomic), 46 bp; double-stranded, linear
aataacgacatacccggcgtgcagcctgatatgtcgtttttttagt

SEQ ID NO: 222 - DNA  (genomic), 2047 bp; double-stranded, linear
atgagtaatgaatcaccgaagcaatcgctattaaatgatttttcacatcgccttaaaatggaaggtgaggaacaactgttccattgtgttaacgaactgaagtatggtttgtcgagtaataatgaatatgacctgtttaaaaatagagaaacctcactgtggaaacgcaaagtaccagaaagcgcagcgctggcaatgacgggaacagtatataaattatttggtagtcgcttactcaacgcccgcaatcagttagataaaaatctcctcgaaatggctatgcaaatggtttatggcaaagatatggtgacaaagtccggggatatattgattgatatacaattaaataaggatggcagcctccagagtaagcactacacatttgatgtaggtgaagttataaacagttataatattgacctctttgtgaatgcttcgagtattaatcaaacttacttacatgataaaaatcctggtgatgttattagcctgtatggcactttagataacattcctcttgtagttaaggaatgcacgggtaaaaatcatcaaattaacgttaaagccaaattgccacaagaacgaagtgaaaaagttgaggatatgtgtgaaagaatgagaggtggcatctctatgtttaatcacaccacaaaaacagctggtaatatagagcataatttgcagctaagttttctcgtggattcacggccgtcgatcaccaataaatactcagccaaagatgtagcgccagacatacttgtattgcccgtcaacgtatatcatgcggattttaaaattaaaatcaataatgcagtagagaagacttagtcaattgtgttatgtgctgtgcaaaaaaatctccatgcagcaaggaaggttcttagcgggataataggtaatgtaccaaaaaataataaaccaaaaacaatcatttttgatttacgttttcttagtgcaattaagcagaaagtttttttgggcagtgaacaaccgttgtttgtaaagcataccgcaatgatgagggaggcatgtaaggaattaccgcagctagtggagtatgttcctttagcctgtgaagcgcatagccatcgcagcgtcgcccttgccaaaaccgtggctgcacccatcatggcgacaggtgtgggcgcggctttaatgtatgcaacatcatcaggaccgtattatgcgcaaagtctttctggttcgccggatatcgagatgataaaaaaacgcatggctgaattgtttaaccagtcggatacttctgtgcgcaacaaatatcgcccggcttttgataaatggaataaactggtagataaattaaatcacgaaagaaatacagttccgtttgcgtgtttgaccaccattatagcgacagcgataaatgaaactcctgagggggatacgaatgttgccgttgtgatggggtgtaaatctgcgaaagatcgcacgatatccattgtccttggcaactcgatgttgcaaacactctttgaaaaacgcctcgccgatgatggagaaatagaaaacctttttgatcaacagggatattttagttgcgattcattaacagccgaagaagtaatgatgttaaaagacctttttgatattcgagttcttcatctctctaacaaatttaatgttgggttgcaaggtaatatcaacacggatgttttacaagattcgttttttaaaaatgtcgatttcattcatgaatctaactcgtataccgtagggatgggagtctgaagagtaaaactcattaggattatcagaattcggccaatgcattgcaaaaatgaaatacaaagagagatgtgtgcaggcgcttagccgcgaggggcatggcgaagccatacagaaagcaccggcattcagaactcctgtgaaagcggcatagtgccgctgctcaggagttttgttatgacccgtatcgtgctgaacgttgccaccctatgatgcgattaaaaaaactcaccgtcgagccgatgattgacgtcaatgctatcggatgatgccgggggtgttccggaaggaattccttgtt

SEQ ID NO: 223 - DNA  (genomic), 1751 bp; double-stranded, linear
aagagttattatttaatgattttgtgaatgtttaaatgtctcagataatttgtctaaacgttatttatatttgtggcttatgagccagcttgaatcatatctaatattttttacgatatttagttaaaaacggcactattgttatattcctcacgttccaggaaatcagcggatttactcatattatgcggcgggatactatccatcggcctgctgaagttggattaaaaattcgaaagtgcacaccttatatttctctatatacgtattccttttggaaagcgtagggtctcctttatttcagggaacgtaaataatgaaaaaatcgacattatctttagccatcggtttattattggcatgtagtaccggtatggcaaaaacacagcatttaatgctggaacaacgcatggcattgctggaagaacgcctggaagcggcagaaatgcgggcggcaaaagcagagagccaggttaaacagctgcagacacaacaagccgctgagatccgcgaaattaaggccgctcagggcaatacgccggtaaatggacaggcaacggcggaatctgcaaagaaaaatgccacctcacctaatcttttgctttcaggttatggcgatttaaaaatctacggcgacgtagaatttaatatggatgcggaaagtaatcatggcctgctggcaatgaccaacgctgatgtgaatagcgatcccactaatgaacagtggaatctcaatggtcgtattctgttaggttttgacggtatgcgaaagatggacaacggttatttcgccgggttctccgcacaaccgctgggtgatatgcacggttcagtaaatatcgatgatgcggtattcttctttggcaaagaaaacgactggaaggtcaaagtaggccgttttgaagcctacgatatgttcccattgaatcaggatacctttgttgaacattccggtaatactgcgaacgatctttatgacgatggcagcggttatatctatatgatgaaagagggccgcgggcgctctaacgctggcggtaatttcctcgtcagcaaacaactcgataactggtattttgaattaaacacgttacttgaagacggaacatctttatataatgacggtaattatcatggacgcgatatggagcagcagaaaaatgttgcttatctgcgcccagtaattgcctggtcgccgacggaagaattcaccgtttccgcagcgatggaagcgaacgtggtaaataatgcttatggttataccgatagcaagggtaattttgtcgatcagtccgatcgtaccggctatggtatgagcatgacctggaacggcctgaaaacggatccggacaatggcattgtggttaatctaaataccgcctatttagatgctaataatgagaaagatttcactgccgggattaacgcgctgtggaaacgtttcgagctcggttatatctacgcgcacaataagattgatgaattcagcggtgtagtttgtgataacgactgctgcattgatgatgaagggacgtacaccattcacaccattcatgcgtcttatcagttcgctaacgtgatggatatggagaactttaatatttacctcgggacgtattactccattctggatagcgacggcgataaaaaacacggtgatgatactgatgaccgttacggcgcacgcgttcgctttaaatacttcttctgatgaagtcgcggtgctggatattttccggcaccgcaactca

SEQ ID NO: 224 - DNA  (genomic), 136 bp; double-stranded, linear
cagagtctgcgtgatgccggatgcggcgtgaacgccttatcccgcctacacaaaatggcattggctcgtaggcctgataagacgcgtaagcgtcgcatcaggcgatcagcatcaggcaatcgattcaggtgcctga

SEQ ID NO: 225 - DNA  (genomic), 1522 bp; double-stranded, linear
tcttccacgcagaggcgccgcaaggcgccttattttttacttcactgtatttttagcagacaacataatctccatcgcctgttggcgatatttatctgccgtatctggctccattaatgcaatgatccccacagccctgggggtgtcttcaagataaacactgatggttcttttctgctgaccatcaaaatttatcaacacatcctgatacttacaggtgaaatgtttggcattacaatcatgaaactggaaggtttcttcattgtattgatccttgagattgtctcgctgcatcttctttaactcttccagcgagtcatcggcgctacgtcctgcgggcaggcggaaagcagaaataaagacgctattatcttcacttcttatatcaatggttttatcagtactaatagaaaccgtattccagtgtcggtttgggacagtcacggaaatagctgccttctcaaacgtatagtgccacggggtgaacagacgaaacgtattgccgacgttggataaaagcaggactcccaatacccaacagcacccgcgagtaaaactggcgaagttacgcgtttttttagtgaatgtgcacagaatacctgacacaagcacgggaagtaataacggtccaagaagtactgaaccgatatactcgccaaccatccctggatctccagtaagcaagttactgtgctgaagatgactaagaaaaacagttattatccatagtattaataagataacgtatctcatatcaatccattattattaacatgcacatcagatcattgacgagcagaaagcatcattttcattacttcttcttgatattcgtccaaataatctgggtcgatagctgcgaccagttgtatcaaattagtgttatccagtagagtcatgaaaatagcatgtcttactttgccatcactcattgtttgcactccttcctgataagcgcaggcaaatccctgaacatcacaaacatgcatttctgcagttccgttttgagtcgcggtaagttcctcgattgaatgcacaccgagttcattttgtgagaaggcaacaatagctaaaatagcatgggcatcccgggtcaccagggttggtccttgttttactatattggcaacccactgtttgctcggaaccgtgacggtgatacctggctccgggaaagtataatcccatatgctgtgtcgttcccacaccgtatagctgctatagataagaaataatcccattaaccaacaagtgccgcgaataaagctgcggctgcttcttttttttatcgttatacagatgattgtggcgataataaatgataaggcaagtgggttaaaaaatacgttagcaaaatataaaatcatttcacccgcgttgccagataaaagaaatttgtagcggaaatggttaacggctataagtaataaatatataaataaaagaataatattctgcatgaatacgtccatgtataaaaaaggggaatttaattccccttttaacgcatggcagatactta

SEQ ID NO: 226 - DNA  (genomic), 5519 bp; double-stranded, linear
cttttataaattctgaaaaattccggggtgttaactcattatcatttcctgttgttgactggcgctaggcttctggttcttatttatttcaaaaggattttacgatgagcggaaaaccggcggcgcgtcagggcgacatgacgcagtatggcggtagcattgttcagggttcagccggggtgcgcattggtgcccccaccggcgtggcctgttcggtgtgccccggcggagtgacgttcggccatccggtcaatcccctgctcggtgcaaaggtccttcccggtgaaaccgacatcgccctgcccggcccgctgccgttcatcctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactctggctggtgcgcggcggcgtggcgaaactggatgaaggtcaccggctggccgcactctggcaggcgctgccggaagaactccgcttaagtccgcatcgttatctggcgacaaacagtccgcaggggccgtggtggctgctcggctggtgtgagcgggtgccggaagcggatgaggtgctgcctgcgccgctgccgccgtaccgggtactgaccgggctggtggaccgcttcgggcgcacacagacgttccaccgcgaagccgccggtgaattcagcggcgaaatcaccggcgtgacggatggtgccgggcgtcacttccggctggtactgaccacgcaggcgcagcgggcagaagaagcccggcagcaggccatttccggcgggacggaaccgtccgcttttcctgataccctgccgggttacaccgaatatggccgggacaacggcatccgtctgtctgccgtgtggctgacgcacgacccggaatacccggagaatttacctgccgcgccgctggtgcgctatggctggacgccgcgcggcgaactggcggtggtgtatgaccgtagtggcaaacaggtgcgcagctttacttacgatgataaataccggggccggatggtggcgcaccgtcacacgggccggccggaaatccgttaccgttacgacagcgacgggcgggtgacagaacagctaaacccggcaggcttaagctacacgtatcagtatgagaaagaccgcatcaccatcaccgacagcctgaaccgccgtgaagtcctgcacacgcagggtgaaggcgggctgaagcgggtggtgaaaaaggaacacgcggacggcagcgtcacgcagagtcagtttgacgcggtgggcaggctcagggcacagacggatgccgcaggcaggacaacagaatacagcccggatgtggtgacgggcctcatcacgcgcatcaccacgccggatggcagggcatcggcgttttactataaccaccacagccagttaacgtcagccaccgggcctgacgggctggaaatacgccgggaatatgatgaatggggccgtctgattcaggaaactgcccctgacggcgatatcacccgctaccgttatgataatccacacagtgacttaccctgcgcaacggaagatgccaccggcagccggaaaaccatgacgtggagccgttacggtcagttgctgagcttcaccgactgttccggttatgtaacccgttatgaccatgaccgcttcgggcagatgacggcggtgcaccgcgaggaagggctgagtcagtaccgcgcatacgacagccgtggacagttaattgccgtgaaagacacgcagggccatgaaacgcggtatgaatacaacgccgccggtgacctgaccaccgtcattgccccggacggcagcagaaacgggacacagtacgatgcgtggggaaaagccatctgtaccacgcagggcggtctgacgcgcagtatggaatacgatgctgccggacgggtcatccgcctgaccagtgaaaacggcagccacaccaccttccgttacgatgtactcgaccggctgatacaggaaaccggctttgacggccgcacacagcgttatcaccacgacctgaccggcaaacttatccgcagcgaggatgaggggctggtcacccactggcactatgacgaagcagaccgcctcacgcaccgcaccgtgaagggtgaaaccgcagagcgctggcagtatgacgaacgcggctggctgacagacatcagccatatcagcgaagggcaccgggtgacggtgcattacgggtatgatgagaaaggccggctgaccggtgagcgtcagacggtgcatcacccgcagacggaagcactgctctggcagcatgagaccagacacgcttacaacgcgcaggggctggcgaaccgctgtataccggacagcctgcccgccgtggaatggctgacctatggcagcggctggctggcaggcatgaagctcggcgacacaccgctggtggatttcacccgcgaccgcctgcaccggaaaacgctgcgcagattcggccgttatgaactcaccaccgcttatacccctgccgggcagttacagagccagcacctgaacagcctgcagtatgaccgcgattacacctggaacgacaacggcgaactcatccgcatcagcagcccgcgccagacccggagttacagctacagcgactccggcaggctgaccggcgttcacaccaccgcagcgaatctggatatccgcatcccgtatgccacggacccggcaggtaaccgcctgcccgacccggagctgcacccggacagcaccctcagcatgtggccggataaccgtatcgcccgtgacgcgcactatctttaccggtatgaccgtcacggcaggctgacagagaaaaccgacctcatcccggaaggggttatccgcacggatgatgagcggactcaccggtaccattacgacagtcagcaccggctggtgcactacacgcggacacaatatgaagagccgctggtcgaaagccgctatctttacgacccgctgggccgcagggtggcaaaacgggtgtggcgacgtgaacgggacctgacgggctggatgtcgctgtcacggaaaccgcaagtgacctggtacggctgggacggcgaccggctgaccacaatacagaacgacagaacccgcatccagacgatttatcagccggggagcttcacgccactcatcagggttgaaaccgccaccggtgagctggcgaaaacgcagcgccgcagcctggcggatgcgcttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgactgtggcgcagatgcaaagccagatggacccggtatacacgccggcgcgaaaaatccacctgtaccactgcgaccatcgcggcctgccgctggcccttatcagtaaggaaggggcaacagaatggtgcgcagaatacgatgagtggggcaacctgctgaatgaagagaacccgcatcagctgcagcagcttatccgcctgccggggcagcagtatgatgaggagtccggcctgtattacaaccgccaccgctattatgacccgctgcaggggaggtatatcactcaggatccgattgggctgaaggggggatggaacctgtatacatatccgctgagcccggtgaatggcatggatccattaggattatatgaatttaaatcaaaaaatatagatgatattggaatatttgcattggcaatgtgtaatggagaatcaattaacgagaataaagaatatggtggactaatatgtaagaagcaaggtgaatatttccccatgaatccgataagttcaaatgataatgatagtgtagacttgcgaaatataaaatgccctgaaggttcagagagagtaggcgattatcacactcacggtttttactctgacgataaaggaaataaagtaacaaaagaaaatgatgtttatgatagtctaaatttttcaagcaaagatttaacgaattcttatatgaatggaatgggaaaaaaagaatgcagtagttacttgggaacaccaaataacacctatctaaaatataatcccaaagctaaagggaatggagttacaattatcaggcaagggagtaattaaaatgaaggcaatacaatgttgttatttccttgctttagtctccagtcatttaatggctggagttatgagtgatgacaatatatttttaagtaattcggatttagctgctttatattgtgtggctaaaatatttccagatggagaaaatattttaatatataaagtaaatataattaatgctagttcaaaaaagatgtatttttttatgaaagcccaacatcaacccacaatgacataatggggggcgggggaatgtcatatgcctatgaatatgatgtaaaatataatatatgtcatttgagaaaaaagagcagaatgaggtaaaaatctttggctgtgtattcagtctggtaatcatccaaggaaagctcatcagaagggtgatgactccaattagtagaacatatattttcgataaaagcaccgatgactttttcatgaagttctacagaactcgagaaacagatggttctgcgggccagacgtttgattcgggttctcagggtcagattgttacgctcaatgtgctgagtaaaaatcttaccagtcagatgcttctcctttggtaactctctagcgtaactaccccattcgtcagtggtcaacatgccgatggtaaaagggtaagcagcgccagcaattcacgacaggtttcatcagtccgggggccaaaagtgtaggccagaacaccaccagttttcgtgttgtacacgtaccagagccagtgctgtcgcgctttactgccgacaaagctccattgctgactaagtttgcagatgagtgccacatcagcatgagcgaccggggatgacgttattcttcgtggcgagagttttttaaagttcggatgactgtattaatgccgattttcagcgtacgggcagtatagcgaaccccggcaccgttgaaagccatttcagcgatttggtctttaactcccggtttacggggctcgtaacagtaactgagctgaaatacccggtgacagtcacggccgcggaatcgatcatgtcttttggggttctgcccgcgacggtaaacctgaacggactggcaacggggacaatgaaggttaactgtgaccatgaaacatccttaaaagcgagtattatatccttaattcaactaattggaggcatcaccgtttaccggagcgacagcttgcggaaaggtcgtgcaactacaaagcaacaaacagactacggcgggaattatttttttcatcatcca

SEQ ID NO: 227 - DNA  (genomic), 2691 bp; double-stranded, linear
acccatttattcactattaatcgctttttattatggctgatagttttatcttgccgaagcgtgcttttttgttattgtctttgtgaaatcttcttataaaacaaacatataaatattttatattgatgagttatttgtatttacaccatcaataaaatccgttaattagcctgtttataagtgaataaaggaatagccgatgatcgaacactatattcgagggtttgaggaagaactgcgtgagatccgccatcagatccacgaaaacccggagctgggattacaagaatttaaaaccagtgctttggttgcggaaaagctgcgtcagtggggctatgaagtagagcaaggactggcgacgacggggatagtggccacgttaaaagtgggcgacggagagaaaagtattggcctgcgggcggatatggatgcgctgccgatttatgaaaatagtggcaagccctgggccagtaaacatcctggtttaatgcacgcctgcgggcatgacgggcataccaccatactgctgggggccgcgcgttattttgccgaaacccgccgttttaacggcacgttacgtcttatcttccagcctgcggaagagatgattaatggcggtgagatcatggttaaagaggggctttttgatcatttcccctgcgatgtcattttcggcatgcataacatgcccggtctgccggtgggtaagttttatttccagccaggggcactgatggcgtcaatggatcagttccatattacagttcgtggttgtggcggacacggtgcgatcccgcacaaagccatcgatccggtgctagttgccgcacatatcaccaccgcattacaaagcattgtgtcacgcaatgtcgatccgctggaagcggcggtaattaccgtcggcagcattgttgcgggtgaggcggctaacgtcattcctgacagtgctgagatgaaaatcagcgtccgctctcttagccgcgatacccgacaacttcttctgacccgtattcctgctctggcacaagcccaggctgccagctttggcgctacggctgaggttacgcatgttaacggtacaccagtattagtaaatgacgaggagatggcgcgcttcgcctggcaggtggcgtgtaaaacgtttggtgaagatcgggccgagtttggcatcaagcccctgatgggcagtgaagatttctctttcatgctggaagcccaacccaaaggcggtttcctgttattcggtaatggcgatgtcggggaaggttcctgcatggtgcataacccgggttacgacttcaacgatgcaagtctggtcccggcaagcagctactggggcgcactggtagaagcctggctgcaataaataaaacaacacacaacaacactttttggcaaggaacatggaatgacggcgatcgtaaatgaaaccgtgagtgtgaagaaaaagcccagcggcaggcgggtgatttttgcctcggcgtttggcaatgcgctcgaattttttgattttggcgtttacaacttttttgtggtctatatcagcacgctattttttccgcccagtgcagataaaaacgtcgcgctactgctggcgtttgccactttcggcgtgagcttttttatgcgcccgctcggcggcattattgtgggggcctgggccgatcgtttcggacgcaaacccgcgatggtgttcaccattgcgctgatgagtcttggtacactgatgatcggcatcgcaccgacgtatgaaacggcgggctattggggaaccgcgacgctggtgctagcgcgtctaattcagggcgttgcggcaggaggcgaagtcggtgcctcaatgtctttgttggttgaatcagctccggcaaatcgtcgcggtttttacagcagttggtcactggcgactcaaggcctggcaacaacttttggaggtgttgtcgctttaggtttaagtgcatggctgccctttgcgaccggttcagaaaccgtcatggctgaatggggctggcgtgtgccgttttttattggcgtgttattagcgcctgtcggctgttggttgcgtttgagtctggaaaatgatgttcctgagccagcacataataagaaggccgcagccagcgaaagcgccttctccttacttatgcaacataaagcgactatcgctaacggtatcttgctcgctattggtagtacagtcgcaacctatatctccctcttttattacggtacatgggcggcgaagtatttaggaatgaaccaaaactattctcatgcagcgatgttactggcgggcgttattacgtttgtgggtgcgctgctggtggggatgttgtgcgattcggtcgggcgtaaaaagctgattttaatctcccgtgtgatggtgctgatctgtagctggccgtcattctggctgttggtgaattacccaagcccaggcatgttgctgacggtggttttcgtgatggtcagctttaccacgcttggcggtgtgccagtgatgttgttgatctctgaactgttgccgaaacggattcgggcattgggttttgcgctggtttatagcattggtgtggcaatctttggcggttttgctcaatatttcgctacgcaatccatcgtgttgctggatagtttgacggctccggcgtggtatctgggtggaggcacgttgctgtcgatgttggcgttgtt

SEQ ID NO: 228 - DNA  (genomic), 131 bp; double-stranded, linear
ggagatgaagaagtgtggcggcggatcgatagcgcagacggcgagcctgttctggaaatttatcgccagtttcaaccgatgtttgctgctggaatgcaccggatgcgccatatgcagcagtatgccgcgac

SEQ ID NO: 229 - DNA  (genomic), 107 bp; double-stranded, linear
aagcgaaaggccatcctgacggatggcctttttgcgttggtgcaaaaaaatgccggatgcgacgctggcgcgttttatccagcttacgcaggcacgatagggggcag

SEQ ID NO: 230 - DNA  (genomic), 6318 bp; double-stranded, linear
ccgggcgctgagactgatgacaaacacagcattgcctgatgcgctacgcttaccaggcctaccagataactgcaatatattgaattttcgagattatgtaggccgaataaggctttattccgcatccggcataaacaatgtgtactttgccaccaatttgagcgccccttaaggcgctgatgtttttttatccttctcgtgcacattgggccgcttcagcaatcagccgcacatcaggtcgcgaagttgccgcggtgaccagccagcgacatgcagagttaagtagcgcgattaatcatgggaaattgcctctgcatgagtgagcagatattgctccgcctcaccggaccagatcccctgatgacgcgccagaatcgccgccagtgcttgatcctgaatctgcgtgagtgacgtcagcggcaggtatttcccggtatacaccagctttttgccgccgccgacggcaggcaattcaagcgtggtttcgcccgcggcattcagcccaagaatatgtgttaccacttttgcggcctgcacttttttctcttcaatcaatttgaccgctgcgcgcatgtcgtcggtattgccgcctgacgtgcccacgtagtgggtaaatgcataatgcacatcgtagaaattaattggcgcgctgaaatgtttatcctgcggtccggcgaagaaattcaggcaaccatctgtcgccagcaaggaagaggcgagagtcaccagtccttcattaggcacaaagacgaaaatatcatcgaagccgtgaccgccactcagcgccattagcgtatcaaatgctgcatcggcggcattgagataatgaatcagtgtttgcggttctgatggatagtgcttgcgcgcataactcaatttatcgttgtcggtatcggtaatgacgagcagcgacgggttaacgggtccatgtagcgcataatcaatcgccaacagtcccattggtccggtgccgccgaggatcagcatgcgcccttgcgggcgaatccccatcgtgtggttataactaccttcctgaagatgatagttggcgttgaacgcgccaatcacgcaggaaagcggttcaaccagcgagccttcaaaataggtttcgccgtcgtatgccagcaggcaatcttgttccatgacctcgttgggaataaccacatgcgtggcctcgccgcctacccacgggaaggagtagccggggcagtccgggcggtcggggagttgcaggttggcctgaatcacataacgctgacccggctggaatttgtgctgccactttttacccacggccagaatatcgccgcaaaactcgtggccgatgatgattgggttggtcgccacatcgtcgggtacttttttatggttttcacccagattggcctctttccaggaagagaggcacaggctgtcagtgaccaccgtcgcgaggatttcatcctcctgcatttcaggaaggtcaaaggtttccaggcgtaaatcacgtttaccataaagacgcagagctgttgttttcataaaccacctcatgttgaacgatggccccggcagtcgtgccggggcgaagaatcaggacaggaagcccagcgcattgccgataatccctaagccaaacagggcgaaaatcagccataccgggttaatttttttgttgagcagacgaaccatcagtagcgtcagaccgagcgccagcaaaccagggcaaagttgatcgagaatgttctgcacggtcatggtgacggtggagccatcggcggcatgcgtttgtgaaaccaccaacggtacgttgattgacgtccatttggtgaccagcacgcccatcacaaacagtccgagaatcgacgcgccttcggtgagtttttgcagcacattcccgcccatatcgctgacgatattcacccctttgcgaaagccgagctgtaggccataccacttcatcgccagacgcaccgcgttgaaaataaagaagaacagcagcgggccgagaatgttgccagacagcgccagcgatgcgccgagcgcggcggtaatcgggcgcagcgttccccagaccagtggatcgccaacccctgccaatggtcccatcagaccgactttgatgccgttaatggtgccgtcatcaatttccgcgccgttggcccgcgcctcttccatggcggcagtgacgccgatgaccgggccacatacggctggcgtggtattaaagaacaccaggtgtcgcctgagcgccgcaacctgatcctcttttactgggtaaagtcgcttgatggcggggatcatgtcgtagcaaaaacccagcccgtgaatacgttcaaagttaaaggacgcctgttgcaggttggagcgcagaaacatgctcaccagatcgccgcgtgtaatttttctctgttccatgatggctccgttaatcgtcaagttggtcaagggcggtggaagcgggggccaggagttgaggttcagctttacgccactgtggatttagctggatgtagaccagggccatgatcacgccgacgccaccgaacgccagcagactgagatcgaggtagccacctgcgaggaaaccgaggaaaaagaaaggcatcaaatatttcacgcccatcatacgtagcaccatggcgtaaccgactaccacgataaaaccgccagcaatttgcagacctcgggtcacaaattcgggaatggcgtttaacatattgctcaccatatcggcgctgacgaacagcgagacaatcagtgccggaatggcgacgcgcagcgcctgcacgccaagcgcggagacatgcagaatatcgagagtgcgaaaccgtgcttcttccgctgctttatccgccgcgtgctggaacactacggtgatggtacgggcaaacaccgtcagcacctggcctgccgcagccacaggcaacgcgatggcgattccggtggcgatgctttgctgaccaacgataaccagaatggcggagattatgctggcgagtgcagaatccggagattgcgccgcgccgacgttcatccagccgagagctatcaattccagcgtaccaccgagtattattccggtttttaaatcaccgagaattaaaccaatcaccgtacaggcaattaacgggcgatgagtctgaaattcatccagcacgctgcccattccggcaatacaggaaaaaagaaatatagcaatgatttgtagggtacttatttccatgatttgtcaccttttaagtgtcgtcatccctgcctgttaaagcatatgtacacaggcgctattatttaatttgcgattaactgttcgtttattttgtagataatattgattgagggatctgacgctacgacgcgtaaatccagtatgacgcctagattatttaactcatgaaatgcgttaatatcatcatcatctaatgaaaccgctttggttaactgttttttaccgggccgccaggccatgccgccaatattcagggtgcctatttttaccccctggcgaaccatcgctaaggcatcctgtgggcgagtgaaaagataaaaaacggtttcgtcctgatattgcgggttgtgataaaccgcgacggctttttcaatattgaccacgttaaccttcattcccggtggcgcagcctgacgcaataatgtccggcgaacttcatcgttataaacttcgtcattgcagataataatgcgctgggcgttagccactttcgaccagacggtagtgacctgaccgtggatcaggcggtcatcaatgcgggcgagcgtaatgttcatcagaaatcctcctctgtcgttgccagttgtttccagacaacgcaggtttgctttgcgatttgcgtcaggtgttcacacagttcatcaacattcatgctgtcctggttatcaaccagttcgagcgccagcggcagagaaagtccgctgattacccgcagacgaggattgcgcatcgcaagcatcgctgccgcattccacgggctgccgcactgtaaatccacggcaatcagccactcattttgattgtgaatgcttactaatttttccagctttgctacgatgtctccggcgttttcaccgggcacaaattcaacggcttcaacattggcgttgccgtaaaccatctgaaccgattccagcatggcgcaagctaatttgccgtgggcacaaaaaatggcgttgaccataaagcctccttagccgcgcgttttgccgcccgcaatgttagtggttactccggtgatatagctggcgcgttcagacagcagataacaaacaaaatcagcgatttctgctaatcttccggcgcgcccaataggaatggcgtttttggtatagccttcacgcagctgctcgacggtgatattgcgcgtccacgccagcgcctcttcatattccggcgtgcgtagcccggttttttccagaatccccggcgcgataccgaccacacggataccgtgtttacccagctctttcgaccaggagcgcgtgaagctattgagcgcggctttggtagcggcgtaacagctttggccttctgagccttccagcccactttctgaggaaacattcacaatcacgccatcatgttgtttgaccatctgtcgcgccaccgcctgcgacatcagaaaaacgcctttctggttgatattgaccattttttcgaatgcagcttcgttgagttcatactgcccggcaggcgctttctcatcgaccagcagacgcgggaaattgaccccggcgttattgaccagaccgtcgatgcgaccaaaacgctggataatttccgctaccgtatgatttacctctttggcgctggaaatatcggtcggccaaaactgatagcctttatgaccttcatattgtccatcgccaccgtgaatatctaccatctgtacgtttgcgccttgtgctaataattcctctacaatcgccagaccaataccggatgcgccgccggtgacgataatgattttatcctgcaaatttaaccacgtttgcataacagactcctgattttagataatagggacccgccgtaatttttattacgataaacatcgggaagatttttatttcagtaatagttcagctgtgctgctattcgttaccagacaattaatatattttccacgcagtgcaccaataattccgctgtatttttcttcactcatggcaatgccaatggaatatcgtgcctgctttaatttattcatttcgatagagagtgttttttcgctcatattcgtttcaaccatttcgccgtgaatatcaaaaaagcgcgagcaaatatcgccagcaacctggcgggcattcaggtcgtcactctcttcaccaccataaaacgcatgccagttagcgccgtcgcgaatggccggtgagccaattcccaccagggcgacatccagattatcccagtaggcagagatggttttaaagtgctgagactgcatgatcccattacgaattaatgggttatccagtagagccggaaaatccgcgagatgcgattcccctttcagcttcgctgccgcgctgtaggttaatgtgtttacgtgatagcggctttcgagtttaccggacggtccgccaataattggtacgcagattaactgccgcgattgccccgcctgcggcaagttttcaaccagtgcgctcaccgcgcgaccccaggaaaaaccgacaatatcgccaggctccagcaagcgatccagcagttgcgcgccgtgtaaccccatcatcgccagttgagtctcttcatcctcatcatttcccgacaccaccacaacgtctttcaggccaaacttttgcttcagttgctgctccagccagagattttcgttgtagtcatagttgatggcgatggtgacaattccctgatcgcggcctcgtttaagcaagcggctgatgttggtgcggtaaatacccagttcgcgcgcgatttgcgcctgcgtcatatcctgttcgtaatagagttgggcaatcttcacaatcaaacggatatcgtcactgttttccattgccgcctcctggttctgcacatttgtgcaaatacgctttctcaccgcttgatctgatataaccccatcatgatggcctttcaaagcgatttttcactctttgcatggggagaaatagcgctttctcttgcacatttgtttctctgcgcagtagttatcagcacaggtgtgcagcgattcgtaatatgttgattatccttattttgccacgcaaatttgcattgtacttccggagacacttttgtgataaaaggcgtggcagatcacatttaatttcgacgttgccgcataaccctgtttttccccgctaaga

SEQ ID NO: 231 - DNA  (genomic), 9306 bp; double-stranded, linear
ctttcagctttcacttcgacaagaagtacgcacaatgattaatcagatgaatgatgcggagtgtaaccatgaaacccgtcctgctggtggtggatgatgacacggctatctgcgcactgttgcaggacgtgttaagtgaacatgtctttacggtttcagtctgccataccggacaggaggccatattgcgtattgagggcgatcctgacattgcgctggtggtgctggatatgatgctacccgataccaacggcctgagggtattgcagcaaatccagaaactgcgtccgacattgccggtggtgatgttgaccggcatgggcagtgagtctgatgtggtggtcgggctggaaatgggcgcggatgattacatctgcaaaccgttcaccccgcgggtggtggtcgcacgactgaaagcggtgttgcgacgggttggcgcgctggcggttaatgacgagaaaagcgccgggctgtcattcaatggctggtatctcgataccatgcgctgccagttgcacaatccgcttcagcaacatgtcgagttaactcagggcgaatatggcttgttactggctctggcgcaaaacgcgcgtcgggtattgagccgcgagcagttgctggcgttcacccacagcgacagcgtggaggtgtttgatcgcaccatcgacgtattaatcatgcgcttacgacgcaaaatcgaactcaacccgcatcagccgatgttgattaaaactctgcgcggtctggggtatgtcttcgctgccgacgtgcattaatccgacatttctgtttgcagctcttccagcgttttcgccccgtcgatggcattggcgcataacaggcttgcccgcgcgcaggcgtgtgccagtttgatgctctcggtaagcgtccagcgttcatggcagccatataaaaatccggcacaaaatgcatcgcccgcgccgacgctgccgataatttcccgttgttctaacttttgcgaagggatccacacgccgccctgttctggggtctctccccacgccccttccgggtagtggatcaccacccgctggcgcacgcccgcatctaacagttcacgcgcggcggcagcaatatgcgcgatatgcggttcgccgttgggtaaccgaatttccagcccgctaaactccccggcctccagttcgttaattaccagataatccagatggcgcaacgcgggcagcaccagcggctgataacgcggatcgcccttacgggagaccaggtcgagtgaggtttcaaagccagtatcacgcatttgcgccagcaggcgtgcgctacgggtgccgtaaacatcgtccggcatatccaggctgtcgagcaacagtaaatagccgagatggaaaatcttcatggtgttatcgagctgatcgaacgccggaagatccaaaagtctgtttgcacccggcgaatggaaaaacgtccgctgcccgcttgggtctgtcatcacctgcgacatcgacgtcggggcaaaggtagtgcgctgcacatgctgacgattgacgtgatattgctcaagcatcgccatgatgtaatcgccgtcgctgtcctgaccgattagcccaaccgcctgtaacggcagcccggtgcgcattttcgccagcgtcagcaggacgttaagcggcgcaccgccggtggagcgttcgctgtgggtgatctccgccagccagccgcgctctggccactggataatctgatggacgtggtcaaccaacatattgcctgcggcgataatccctttacgctccatcatgcctgccccgcactgccaaaaatacgcatctgttgtgcaaccgtatcgctgatggcggcttccactgccagcagtaactcggcaaactcgtcatacatcggctgacggtgcgccattcgggcctcaacggcagccagcgccgcttgcgacatgccagtgtagaaattgattttgtggatacccagttcgatggcgcggcggaaatcggcatcgctaatccctgagccgccgtgtaataccagcgggatagcagcctgctggcggatagcgtcgaggcgcgggaaatcgagtttcggttcgccgcgatatttgccgtgtgcattgccaatcgccacggccagcgcgtcaatgccggtacggtcgacaaaatcacgcgccagttgcggatcggtaaacagggattcatcggcatgaccatagagtgcaccgccttcgtcgccacccaccgcgcccagttcagcttctaccgatacgccaacggcatggcacattttcaccacttcccgcgtctggcggacattttcttcataccccagcgtggagccatcaaacattaccgagctgaatcccagccgcaacgcttgcaccaccgattcaaaatgtagtccgtgatcgagatttaacaccaccggaatgtcatgacgcgccgcttcaaatttcactgtctcgaccagggaatccagcgagatatatttaaaatgtacttcggcaatgttgataataaagggcgaacgttcttgtctggcagcagcaaacaaggcgcgtaaaaagtgcgagtccagcacattaaacgcacctaacgaatagtgatgttcgcgggcatgtgccagcccttcagcgagagaaatcaatggcataacgttatccttattcagcggaactggcggtattcgttacacaataccaactgtgcaggttcgtcttcgtcaatcaggttgtagcggtccagtggctgtaaaaagtggttatcgtggtcgtcgtcattaacagaagagacttcgccaaccagcacatcgccaaaaccggcttctgcccaaaagctgtgatacaggccgggcggcaggcagatactttcgccgggagacaggcgcaactgagagcctgcagtatgtttctggcggcagccgtctatcaccaccgtaatgtcactatcagccgtttgctcgttactatcggcattccacagttcaacaattaaattaccgccgccgcgattgataatgtcctcacgcttacgccagtgaaaatgcattggcgtgacctgcgcatcgcgcacatgcatgatcttctcggcgtaacatttcacatacggcattccttttgctgagccgttacgtagggtaaacagcgtcagcccgtgtgctgcaaagttgttgcgaccaaaagcggtaacatcccagccgagtttaagatcaaaaacctcctcccacgcggcggtgtcgagctgctgccattgagcaggcgagaaactggcaaagggcggcagatgtacgtcatgttgcgaaaagaattgccgtgtatggccgagaatgtcgtttatagcggagcgtttcatcgaaagcgttctccttagcggtgaccgggcagctgcgccgcccggcgtgtggacttatttcaccgtccagcctttgtaattgccgacgttgtttttatcgatcatcgtcaccgggatcagcaccggctctttcggcgcaggtttgccctgcaaaatgtcgtagccaatttccaccgctttcgctgccatcacctggggatcttgcgccggagtagcgacaaacaacgagttctcacgcttgagcgcctcttcggcgtccgggcttccgtccacaccgacaataaagaactcgttacgttgtgcctgttttgctgccagatcggcaccgattgcggtgggatcgttaatcgcaaatacgccgtcgatcttcggatttgccgccagcagtcccgtcattacctccagcccgccttcacgactgcctttcgcgttctggttgtcagagagcactttgatgtcaggatggcgtttaaattcagtctggcatccttcgacgcggttttgcacggcggataccggcgggccgttgatgatcaccacgttgcctttgcctttcaggcgatcggtgatgtatttacaggccatttcgcctgcctgggtgttatcggaagtgatggtggcatcggcaccttctgccgctacgtcaaccgcgacgaccacgatcccggcatctttcgcccgtttcaccgccgggccgatcccttttgaatcggcagcgttgaggataatcatatcgacgttagcggcgataaagttgtctatctgcgacacctgctgacccagatcgtagccgctggaaaccagcgtcactttgacgttatcgcctgccagtttgcgtgcttccagctccgcgcctttggtgatctgcacgaagaacgggttcgccagatcgcccaccgttacgcctattgatttcagttctttcgcctgggcgaacggtgctgcggccagcagcgcgcctgcacagagcgcggtcactaagggcttcaatctcatgctgtattcctcatgtgtttatgcactttgatggtgtcgggtacggtatttgtcgatcagcaccgcaatgatgatcatcgcccctttgatcaccagttgccagaagtaagagacgcccattaaggtcatgccattgttgagcgtggcgataattagcgcgccgaccagcgtgccggtgatggtgccgatgccgccgacaaaactggtgccgccgaggatcaccgctgcaatggcatccagttcgtaacccatgcctaagttgccgttggcgctgtacagccgtgaggcgctcataatcccaccaagcccagaaagcaggccgctcatgccataaacaaacagcagcaccagccagaccttaatgccggtaagacgcgccgcctgcatattgccgccgacggcgtagatatgaacgccaagcgtggtgcggcgcagaataaaccagcacaccacgatcaccgccagcgcaatcaccaccagccatgggaccggcccgagatagttgttgcctatccactcgaaattaatgttggagttgataaccgtggtgccgtccgccagcagatacgccgccccgcgcagcgccgtataggtgccaagcgtaacgataaacggtggcaatccggcaaaggccaccagcgcgccgttgaacagccccagcagcaggccgagcatcagcgctgccgggatcgacagcatggcgaactcagggctaagggagacgaccatcgccgccaccgctgtggtgccgaggatcgaacccacggaaagatcgatcccgccggtcaaaatgatgaaggtcatccccgccgccagaacaatgttgatcgatgcctggcgggtaatattcagcaggttgctttcggtaaaaaagtttggcgtgataaagccaaataccgccacgatcagaatcaaaatgggcaagatgccgaccgtttgcatcagatcgctcatcagcatttttttggcagaggtttttgcagaggtcgtcatgaggttaccgcctgggaatgggcgtcgttgacgccagtcgctaaggtcataatgttttcctgggtgatgtttttgccgtttaactcaccggcaatgctgccttcgcgcatcacatagacgcgatcgctcattcccactatctccggcagttcgctggagatcatcaggatcgccacgcccttgcgcgccatctcgttcatgatccggtagatctcacttttggcgccaacgtccacgccgcgggcgggttcatcgagcagtaaaatgcgcgggccaatcgccacccagcgggagatcaacagtttttgctgattgccgccggaaagcccgcccgcgcgtacctgggcatgaggcacgcgaatgttgagcaacttaatggcgtcatcggaaatggtttgcgcttttttgcgattgagcattccccagcgggcatcgcgctccagggttgccatggtgatgttttcggctgctgccatttcaaggaataagccttgttctttgcggttttcggtgagaaaaccaatgccaagatcgatggcttcgcgcggggagtggatcaccaccggttcaccatcgacttcaatcattccgcctgtcgctttccgcacgccgaagatcaactgcgccagttcggaacgtccggcacccaccagtccggcgaggccaacaatttcgccggaacgcaccagcaggctactcggctggactttgccgccgtcggtcaggtggtgaacattcaggcgggctttaccgagcgggatatcgcgctctttattgaacagatcgctcagtggcctgccgaccatcatccgcaccagctccccggcattgaggttatcgcgggtcaggctgccaacgtattgcccgtcgcgtagcacgctgacgcgatcggaaagctcatacacttccgccatgcggtggctaatgtagataatcgccatcccttcatcgcgcagccgcataatcagttcaaacaggcggtgagtttcgcgggaggagaaggcagcggtgggttcgtccatcaccagaatgcggctgttgcgatgtagtgcgcgggcgatttcgacctgctgttgctcggcaatggtcagcgtcatgaccttatcgctggcgttaaactgcgcgccgaggcggtcgatcactttttgcgcctgcactagcatctctttacgctgcaccagcccgccgtgggaaagctcgctgccgagaaaaatattttctgccaccgacagattcggtgccagctgcatctcctgataaatcagcgtaataccggcgcttaaggcatcttttggcgtgcgaatgtgaaagggcttgccgtctatgagaatctcgccgctggtggcggtatacgcccccgccagcaccttcatcagcgtgctttttcccgcgccgttttcccccatcagggcatggatctcgccagggtagaccgtcaaatccacccctttgagtgcataaaatttgccgaaggctttggcaatattgcgcatctccagaactggcgtgctgttcatggtggactcctgcgaggttgtcgatatcagcactccatcacaggaaagtaaatgcaaaatgtcagaagccgttcatatttgtcatattgcgatttttcttcacggagcgtgatatggcgcaccccggacgtcacttttttgccagcgcgcgcgggcgattgctgcttttgaatttgctggtggtggcggtgacgttgatggtcagcggcgtggcggtaatgggctttcgtcatgccagccagatgcaggagctggtgcagcagcaaacggtggatgatatgaccggcagcctgaatctggcgcgcgacacggcaaacgtggcaacggcggcggtgcgattgtcgcaggtggtgggagcgctggaatataaaggcgaagccgagcggttgcaggagacacagcgggcattaaaaagctcgcttgcacaactggcgaacgcgcctttagcgcagcaggaagccgggctggtgacgcgaatcatcacgcgtagcaacgaactgcaaaccagcgtcggcggtatgctggagcgcgggcaaaggcggcatctggagcgcaacgcgctgttaagttcgctgtatcaaaacttaagttatctgcggcatctgcaaaaagtcactcacgcgcaagatgatattttgcttaacgagatgaaccgactgattgttgccgctattgccacccccgcgccgcaggcgattattcatcaactggtcggggtaatgtctgcgttgccgacccacagcgatacgccattggttaatacgttactcaatgatttcaatgatttcaatgatgaaatgcgtaaactcgcgccgctttctgccgctctggagcaaagcgatctggcaatcagctggtatatgtttcacatcaaagcgctggtggcgatcctcaatggcgacatcaaccgttacgccgaacaggtggcgacgctctccggtcagcgtgtggcgcaaagttaccaggatttgcgctccggcgagagggtgatcatgattttcgccctgttagcggtggtgatcaccgcgtttgccggctggtatatctatcgcaacctcggcactaacctgacggcgatttcccgcgccatgagccgcctggcgcacggcgaagcggacgtcacttttccggcgttacagcggcgtgatgagttgggtgaactggcgcgcgcctttaacgtttttgcccgcaataccgcgtcactcgaacgaacctcacggctgctaaaagagaagaccacgcagatggagattgcccaaactgagcggcaggggttggaagaggcgctattacacagccagaaactgaaagctgtcgggcaactgacgggcgggctggcccatgattttaataatctgctggcggtgattattggcagcctggagctggtgaatccggactcgccagacgcgccgcgaatacagcgggcgctgcaagctgccgaacgtggggcgctactgacacaacgactgctggcgttttcccgcaagcagtccttacatccgcaagccgttgaactgaaaacattgctggaagagttaagcgaattaatgcgccactccttaccggcaacgctggcgctggagattgaagcgcagtctccggcgtggcccgcgtggattgacatcagccaactggaaaatgccatcatcaacctggtgatgaacgcccgtgacgcgatggaagggcagacgggaatcatcaaaattcgtacctggaatcagcgcgttactcgcagcagtgggcagcgtcaggacatggtggcactggaggtcatcgatcatggctgcggtatgtcgcaggcggtgaaaagccaggtatttgagccattctttaccaccaaacagacgggcagcggcagcgggctgggtttgtcgatggtctatggttttgtgcgccagtccggtgggcgcgttgaaattgaaagcgcgccggggcaggggacaacggtcagattacagcttccccgcgcgctgacggcggcgaaaaacctatcgccagcggcagtagaacaggcttctgtcagcggcgataaactggtgttagtgctggaagatgaagccgcggtgcgccagaccatctgcgaacagttgcacctgctgggctatttgacgctggaagcaagcagcggcgaacaggcgctggatctgctggcggcatcagcagaaatcgatatttttatcagcgatttaatgctcccggcggcatgagcggcgcagaagtggtcaatgcggcccgcaaactttacccgcacctgacgctgctactcatcagcggtcaggatttacgccccagccataaccccgcgctgccagacgtggcgctgttgcgcaaaccctttacccgtgcgcagttggcgcaggcgctggggcaagagaattgagaatcctcctctactcgtaacaggcacctttgcctaccttgtattaactttgttgcgaggccgagtttatgaaacgccactccacgct

SEQ ID NO: 232 - DNA  (genomic), 164 bp; double-stranded, linear
agctctcgactgatcatatgaaatcctgcaactcatcgtctctccggcgatgagttgtcaggaagtaatgcgtatggatgatactctccagggccggtgataactgaagatgatgttaagctgctaaatgagccacgttgacatcatttggcagcttcatgcat

SEQ ID NO: 233 - DNA  (genomic), 1748 bp; double-stranded, linear
ggtgcgccgtaaaaccccgtccttcagggcggggatatacggcgcggttttccacctaaccaggtgtttgctgttgttcaatgtattgacggatggcggatattggcgcacctccgcagctactggcaaaatagccaggactccacaaaacgcctttgtagtaatacctgactgcaatatctggtcgatctcgtcgcagtaacctacccgatacgcctttgaggctgtttaccagactggatatcgccagtttgggaggatagttaattaacaaatggacgtgatctggttcgccatccatttcaaccagttcagcttcaaaatcagcacatacctttgaaaagtaagtgcgtagtttttctgtcgcgtcatggtcaaaaatctggcgtcggtatctggtgacaaagaccaggtgaacatgcatcaggaaaacacaatgccttccacgccggatatcggtttcttttttcacagaccaaagtatcatttggcctgtgaaacgactacaggcatttaaattccagttaagacccggtggtcaacaggagcgtgaaatgaggcgcttcgcaggcgcatgtcgtttcgttttcaatcgtgctctggcgcttcagaatgagaatcatgaggccggtaataaatacatcccttacgggaaaatggcttcctggctggttgagtggaaaaatgccactgaaacgcaatggcttaaagatgccccgtcacagccattgcaacagtcactgaaagaccttgagcgggcttacaaaaacttcttccggaagcgggctgcttttccccgattcaaaaagcggggacagaatgatgcattccgctacccgcagggcgttaagctcgatcaggaaaacagccgtatttttctgccgaaacttggctggatgcgctaccggaatagccgtcaggtcacgggtgttgtgaaaaatgtcactgccagccagtcctgcggtaagtggtacatcagtattcagactgaaaatgaagtatcaactccggttcacccttcagcattaatggtcggactggatgctggcgtggctaaactcgccacgctgtcagatggcacagtctttggacctgtaaacagttttcagaaaaaccagaagacgctggcgagacttcagcgacagttaagccgcaaggtcaaattcagcaacaactggcagaagcagaaacgcaaaatacagcgactgcattcctgtatcgcaaatatctgcagggactaccttcacaaagtcacaacgaccgtcagcaaaaaccacgcaatgatagtcattgaggatttgaaggtcagcaacatgtcaaagtcagcagcgggtacggtcagccagccggggcgcaatgtccgggcaaaatcaggtttaaaccgttcgatactggatcagggctggtatgaaatgcgccgccagcttgagtacaagcagctctggcgtggcggtcaggtgcttgctgttccgccagcgtacacaagccagcgttgcgcgtgctgtggtcatacagcgaaagaaaatcgcctgtcacaaagtaaattcagatgccaggcatgtggatatacagcgaacgctgatgtaaatggcgctcgtaacattttagcggcggggcacgccgttcttgcctgtggggagatggtgcagtcaggccgcccgttgaagcaggaacccaccgaaatgattcaggcgacagcctgaacgtagcagggatccacgtccttcagggcttggaggatgtcaaca

SEQ ID NO: 234 - DNA  (genomic), 26 bp; double-stranded, linear
tgagcaatgcgaaaaagcctgttagc

SEQ ID NO: 235 - DNA  (genomic), 46 bp; double-stranded, linear
tcaacgcgggatgcgacgctttcacatcacatccggcatttgctta

SEQ ID NO: 236 - DNA  (genomic), 32 bp; double-stranded, linear
tgtatttcccggcatctttatagcgatatcaa

SEQ ID NO: 237 - DNA  (genomic), 29 bp; double-stranded, linear
tgattaaaatgcccgatagcacacactag

SEQ ID NO: 238 - DNA  (genomic), 194 bp; double-stranded, linear
taggtcggataaggcgctcacgccgcatccgacaataacagcattgcctgatgcgacgctgccgcgtcttatcaggcctacgagttcggtgctgtgtaggtcggataaggcgttcatgccgcatccgacaataacagcattgcctgatgcgacgcttgcgcgtcttatcaggcctacgagttcagtgctgtgta

SEQ ID NO: 239 - DNA  (genomic), 90 bp; double-stranded, linear
ctgcgcactcttcaccgctaaattcagcagattgcgagacgccttccaaagagatttaagtgccgggcgacaggcacccggcaaagagat

SEQ ID NO: 240 - DNA  (genomic), 10236 bp; double-stranded, linear
actcatctaaactattgttttaaaacaatttaattcataatcttgcttgaaatcgcgtagcccctcttacaaaagggtatacgaggcgatgtctcagcgatataaactctatcgtcgaaccagcggcatttatgttgtccgcattagcgttccccaacgttttcgtcgatacgcaggacagtgtgagattcacacttcaacaggcactcacgatcttcatgaagcaaagcagaagtccgcgctcctgttggcggtctggtatcagaccttacaagagtatgaacaattggattatcgaactttaagtgactgcgccccactgcttgctggtgagggtatgatctcgctttctaactttgctcaatcaatcgagttgcctatatcgcaattgattcgagaggtggttaatcgtaacctcccggtattctggctggcgactggtcagttcggtttctatgttgatgaatttaatgcagtagagcgggaaccgggtgcaaaacgagaaaaacagtctgatgatgaaaaggatcaacctaaagaagtcatcattctcaatagcgcgtttgagctgggtatcgagagcttcgcaaatggttatctccgccccttcaatccccggcatactttagattgtctgttgagcgctggagtatccgaaggagaggctgcatttcgaactagtggtgataaccaaagtggaggttggttcttcgatttacccggcgtagatataactgctgatagcctgttgattagcaaagttcatgctgaaggccttcgacttacatggctggttaagaccacgccaccagcagttagcattcaccctgccgtgcctcttgtcgctcctgttatcgctaatgaatatgttcaccgcaaacattacaatgaaaacttgtcatggcttcgtgaagagtatttgaaacatcgacgtaagggcaaggtatcagaagcggcgctccgcgatattcgctattacttcgatttgatgattgaagtgatgggggatattcagttggaagatttcgaccgtgatttcctccgggcttatgagagcaagttgcgcacaattcctgctaaccgtaatttgatgaaaggtaagcacggggttaagacgctggatgagttaatcgccaaagcggcagaatgtggcgataaactgatgacagaagagtctgtcaaaaagtatatcaacggcctttatggtgcaatggagtgggctgttgatgatggtaagtttctgaaatcgccatgcgacaactttttccctcccgatgacaaaggtgagcgagagcaggatcacactgacatatttgaaccgcatgaaattaaggcaattttttcgcaaccgtggtttgtcgctggaactgttgaacgtaatgcgcaagggcgattccatcaatattgcccgtttcactattgggcgccgttgttgggcttgatgacgggggcaagggttaacgagattgcacagttaatgctggacgatgttctggcagatgacggcgtttattacctgaaccttgaaagcgatagcgaaaacggaaagaaactaaaaaacgccaattcccgccgcaagattccggttcattctacgctgattgaactcggttttatcgagtatgtggatgcgttgaaagctgccgggtatgaccgtctttttcccgagcttaaaccacataaaaccaaaggctatggtaggccggtttccgcatggttcaatgaatcattgcttgcgggtcgattaaaacttgaaagagacagaagcaaatctttccactctttccggcattctgtttcaactttgcttaaagagaagggtgttagttcggaactgcgtgggcagctacttgggcatgtgcgaggcaaaacagaaactgaagtgcgatacagcaaagatttaaaaccggttcacatggttgaggttgtcgaaaagattgatttttctttgcccgagatagcgagattcaacattcctgatgggctggatgctgtaagagatgcgctgcgaagaaagcgtggcaaacaaacaggttgagtcagttactattcagttgagttatgctcttgaatgcgctgggacgcttcctggcgcattttttattaaaggtcgtggatttaatagtgccaaatttggagacgcttaaaatgcgtctggtgagacttgatttgcattagctcagtgaaccgccccggaaatcctggagactaaactccctgagaaagaggtaaacaggatgactaaaaatactcgtttttcccccgaagtccgtcagcgggcgattcgtatggttctggaaagtcaggatgaatatgactcacagtgggcggcaatttgttccattgccccaaagattggctgtacgccggagactctgcgtgtctgggttcgccagcatgagcgggataccgggggcggtgatggtgggctcaccagcgctgaacgtcagcgtctgaaagagctggaacgtgaaaatcgtgaactgcgccgcagtaacgatatccttcgccaggcttccgcttattttgcgaaggcggagttcgaccgcctctggaaaaaatgatgccactgctggataagctgcgtgagcagtacggggtcggaccggtatgcagcgaactgcatattgccccgtcaacgtattaccattgtcagcaacagcgacatcatccggataaacgcagtgcccgtgcgcagcacgacgactggctgaagagagagatacagcgcgtatacgatgaaaatcatcaggtgtacggtgtgcgtaaagtctggcgtcagttgttacgggaaggaatcagggtggccagatgtacagtggcacgtctcatggcggttatgggacttgccggtgttctccggggtaaaaaggtccgtacgaccatcagccggaaagccgttgccgcaggcgaccgcgtaaaccgtcagttcgtggcagaacgacctgaccagctgtgggtggctgattttacttacgtcagcacatggcagggcttcgtctatgtggcgtttatcattgatgtgtttgccggatacatcgtggggtggcgggtctcatcgtctatggaaacgacattcgtgctggatgcgctggagcaggcgttgtgggcccgtcgtccgtctggcaccatccatcacagcgataaaggctctcagtatgtgtcactggcctatacggagcgactaaaagaagccggattactggcatcaacagggagtacaggcgactcgtatgacaacgcgatggctgagagcatcaatggtctttacaaagcggaggtaatacaccgtaagagctggaaaaaccgtgcagaagtggaactggccacactaacgtgggtggactggtataacaatcgacgattgctgggaaggctgggccatactcctccggcagaagcagaaaaagcttattatgcttccatcggaaacgatgatctggcagcctgagttcacagataaaacactctccaggaaacccggggcggttcacagaattgatctgacggttttctctgacagcatacaatcaagtctaacagtccgccttgagcgaggagcggacactcatgattcttacttatatatattttcctacatcgaatttttttaggggaaaattatttagttagtcacactccgccagtcaattctgcgattagtggttcataaggtgcgccagcttgtagtgcattccagatttctaaaattttatcacgatttctccccaaccaactcgaaacatcactatcatatttcttaggtaaatctccctctatgcggtctcctgattgtatggcataactggcagcatgcgcttgttttccatagtcaatatgaatatggggaagttgatgtcctttttcttgatatatttttatcttcatgttctgtctcttcaccaagagaatttccatgaatccgccgccactagagcgtcttttctcagtcagtagatccttctgagcaaagagtttttgtaattcgtaaaattcttcatctaaattcatatatcacccattaaatttcagttagtagttattaaactcaactctttatcgctaggcttttcctagtccacttttggcacaaagctgtttaggtcaaatctaagctaatacacttgattacttacgattgcatccgcagccctttcacgctttctgatggtaggctaatcactgttttaatgcagttctctatgctgccaatgatgtcttcgcgtgggccgctgcgccagtctgcgcttgcgtaaaaagcatcgagaaccgcagtcatgcttttagcgctgtcaaaggcgcgaatcaagtagtagcaatccaggtcatcaagcgagttgccaaacgaaacaacatcgatcccgtggctttggtgtaggggaacactgatttcctgcattatggcgtgaaaagcggcaccgctgcctttgcgtaaggtgtattgcagtatttcgacggttctcaagcgttatctccgtgttgcccttgggcggctcctagttgatagcaataaagtaaaccggactgggccatgaagctactgctaatcagacagtcatccgtaagcagaagctgcgatatgcggttcaaacgcgctgtaaggctctctggcgagtgttttaaagaaggtagtcgaaatcatggtgcagaattcgcggcgctctcatagagtgactggtgaagccagttgaaacaagcgtagcggagttcgagcaatcaatgagaaatctgggcgagctttagttttaccgcgtcgcttaactttggaggctgattgcctctataaggactgtctcaccgccacggaaattatcggatgcaatgcttaagaggggcgcttccaaacctaggacatccactttttcgctcccaacttatccggctgcatttacaccgcgaacacgttgaacgttagcagcttctggttcgtgtttggttgttacgcatgtgaggtaaaaacggcagctttacttttgacgggaacgccataagacaccaaacagcagagaagtgtaattgttaaaaatgttaaaacataacttgttctttaagatgtaaacccttcctcgggggggaagccggacatatcaaccctaaggccatctgagaagatagcctgtaggtttgctcggttccccttgccagatgaagatcaagtcttcctcgtggtgtgacgacctttcttgaaagatgcattatgcgcaaaagaagctacttaagaatccgccgatagctactttcaccctctgcttggctgcatcaaacgcttgcgcgccctacctaccacaatcaacgttacgcagagttcccatcctgacgtcttccgctaaacagcggtgatctccacctacccggaccggtttaccgcatgaggtaggtgtcaggagagaagctagcacaccatcattttaaagaaaagtcatatatatcatatggctgcgttcatattctgaacgcagttatcgatgttaacctaaaggtatgagaacactgtcgtttttcatatacaaagggtgcttcggctcacctgtagcgtttaagacgaagcacattgtgctctctggcaatagctgtcggacggtcgttgagcgtttgaggtgtcttccttcatttccccatgcggcgacaaccagtccggcaccgctaacaagacgtatcaagtggctatcgttatctttgccaatgggatcagacgctttcatcatttcatgtcgctgggtgtgaacgaatgcgaacaggttggccatgtatacgccaccgtagccccagcttttggcaaacgatatgcagcggctcaaggtgcgatcatccttctcggcatcggcgtatgaagggtttagccctatgaaaagggtatacggttttgattcgtcccagactcgtgataacgagtagcgatacttaccgcacggtgaaaaaatcgcgtctttaatcatttcggttgtccttatgaagtgatggtttcagcctaacatgtcttcacccgttttaagcgccaacaaacgaccgttttccggcatcctccaaccgcacgctttcacactgttggaaaattagccttggcttttccggcaggccatcctattttcatcaccgttttctggcaggggccggatgaggagatgactatggctatttttggctacgggcgtgtttcgacatcccagcaggatactgagaaccagcgcatggaacttgaacaagctgggtggacgttcgacttttggttttctgatgtagtcagcggaaaggttcctgcggtgcaacgcaaagcgttttttgaaatgctcagcaaaatccgcgatggggaaacgttggtagttgcaaagctggaccgcctcgggcgtgatgcaattgacgttctgcaaactgtcaggacgttggctgaccgaaacatcaaggttattgtccatcagcttggcaccactgatctcacctctgctgccggtaagctcctgttgtcgatgctagcagcggttgcggagatggagcgtgacctgctgattgaacggactaatgcggggctgttacgggcaaaagctgaaggcaggaaattgggcaggcctgctaaaatcgcaccggaagctcgtggagcgattttagacaaaagggccgctggggttagtgttagcgcattggcgcgtgaatacggtgtttcaagagcgacgcttgctgcattactgaataagggttactgatatacttaaaacatgctctaacactttgcagatacgagcaatacttggtaaaacagcacactttccgccagaatcggatttttgaggtcctggcaacagctaattgctgagaacatttcagtaaactgtttaactcgctatcagccgaacactgatttgtatagaaatgctaccctcgttcatactatcaaaaataaattaattttgatgccagccaggttggtcattctcaaatacctcagcctcggggaatattttagtcaatgggataacatatttgaccagatcatgggtaaaaaagtcatccgcagtttcatctaccatccacgcagagttctcatctatgcgtggcacgagataatgaacattcaggcggactattttagatttttgctcaaaatttactatggcagcatagtttttttcccttcgtttatcggcaacatccttttgaatatctacatccaaagctatatgccctacgcctagaccataatccaaaagctggttatctatctctgctaatgtttttgttacatgtcgcgaacgtgcatcgaaagatttttcattgatacaacgccatgttatcaaagaagcaagtttaactttggttatgaaacgtgagtcgcgctcatctggtcgtcccatagcaacaacttggtaattttcatcttccagaggggagcctttgataagacgagcaagtttagtgttgactagtaatgagccgttttcagtgatatcttccctgataagatttaagttggccggtctaatcgttccttttccataatcatcattccattcataaaatacacctttaaagttttttaagtggctaatgatatagttttcaggcgcgtctttaacttcacataaatatgtgacatcagtccatacgttcatctttttggatttgatatgaagttcggcaagatgtgagcgtatatgatgctgtaatatttcctgctttacgtaaggacctttctgaagccttttgcattcgacaaagaaataatcgccatctccaaggcggcaacgaaactccggggtttttgctatccctttttgttctggaatgaactcaacttcataaccttctgatgcatagtttccagcaagaaccaactctaataaggctgtgtctggtaatactgttgtattcttaagcattctgattgcgcgatctctagcgccagtaattctatcgagcgatttagcacacactcctaattgtttaacccatggtattatatttgaagcattagtaacttcgtaagaccttctattatcgataagcgattttgcttgtgcgaaataaccagcaaccacgtcggaaccataccattctgggtcaaactgtttcccgaaattggcagctttttgggttgtagctatgtaaaattgctgtgcttttgctaagcgctggtaaaagtgttgtttgttctcttgagttgatgctaaccactcaagaccagcaataacgtcagaatctagcataacaccgtcattcatctttattccttagttcagccctgaaaggcactagatcaactgagacagattatagttacggaaagataacgcgatgaatatacgatggtaagcctccgctttccactctatgctggcagctgagttctatcatgttcaggcacctacgtttctagaagttgttcatacagttagtataaatatacgtccctgaaatctttgcgtcttgctttggatgttcatatacgtagtcaacaaaagtcttatagagcgttatcatctgctgggtgacgtcggccttaccgttcatgttatcaagtcgctgataatattctcttttcgtcatcccactgttacggccttcggttacgtttgcggtaaattgagccatacccatgcacatttgatctttattgttattcatttgatctttattgttattcgttttatccgggtggagagcgccttccaacactttatcaccgctgatggcatgttgcgcccacgctgaattgttagcgataaactttttggagccgatggcaataccgtattcaacgcgaattccattgtcgtgataactgccatctgcgtcttttgtcgctagctttaaagatatacggcaaccgggaagcgttttgtgttcttgcaccgagataataacggtgtccgtatcgcaatcagcaaagctgtattcggggttaacgtaagtgttagttttgattaacagcccggtaagaccgtttttatagccttttgccggcagcgttttgaaggcgctgcgttcaccctttttgatcgcttcccggaagtgatccataccgatgcgcgtcgccagttgatcgatgctttctgctgcataagatgcagatgacgcagcgattaacataatggtcagcacagacttggctgaaaaaccgggcttactaagccgtgtttttgacatgttgttatccctcagaatccaccccagcggtgtcagttatcgcatcatagaccattgattcaaaatgtcactattggagcgtggctctttagtggacatctgcgcaaattcaggtcatgaaaatgaccctgagaaaactgtttggacaacgagtaaaagagttgcgcattgccaccggaatgagccaagaagcctttgccgatcggtgtggttttgctcgtagctatatgagccgcattgaacgcggtggctctaatgcgtctttggatgcgattgaggtgctggctaatgctctgagtgttgagccgtggcgactattggtgtctgattcatctgaagatagtgacccggaattactggttccttatgcagctgatggctcgtgttttcatcccgggctggcaagcactcgcgatggctcgtttggcgtaggtgataaaacggctcagaagcggtttggcacgttttctgaagctcttgagtatcttcgtagcatggagacagcaaaatggcgtaggcctaatcctagcggcaactggggtattgtatctgcggttcggtgggacaagctgagaaagtagctcaagtgtaagtttatgaattttcatgctgtatggatgaacagtgttcattagatgctgatagcctcacgtttcatcagctctttgtttctataagagtgaataaaacagcaaaatgcgggtgcgttacgtaggcgttacggtggcgttttactttgacgctgaatggcttaattcatataaataacattgagttaaatagttattctgaacaaggtctgacggggtttaactggtttcaaaatccgaacgcagtggcgtttacttaacatccacatagctgacaaatgttctttcctcccgacccactagacctccataaacatcaaaaggcaggtatggcacgttaatgatttgtgccgccacgaacactcggtttgattccgtccagcggatcaaacttaagatgtagcccctagaacaaaaaggtcctacgattgttcttttaaaggctaataggaacgtgattacagcaggttatggagacttaggttcgagtccggccttcggcaccaaa

SEQ ID NO: 241 - DNA  (genomic), 1089 bp; double-stranded, linear
cttgattggtattgcagtaagcagagggttggactggtacagtaaatatcccgcataatcgtgccattcacatttagagatcctccggcataatcaatctgccaatgaaggagatcgctattcgtaaagccccttttactgagcatcagattatcgccgtgattaaatcgcttgaatacgggcgaactgttaaagatgtggcttatctgaagccacttactacaactgcaagtccagatacggcggtatggaattttctgatattaaaataatcaaggatcttgaggatgagaaccaacgtttcaaatagatgtttgctgatctcattatttggtcgggatttttaaagatgtatggaactaaaacgggtctattttcagagggatttaactgaagcagaaattaataaatcataatttataggtggctggtatttaatattcctgcatcatatctctgatgcaggagcagagaatggctataaattattagtaaacagaatgtctatctctcacccacaaacccctcataagggtaatttttacgcacctgcggcaacgcaatagttttcccgtcaaaatcccagaataatctctcaacgatccctccgccgtttaccgcatccgagaccagtacccgcatattttcatccaggccaatcgatcctttatcaaaggctttatggtgtattgcgcaaagcgccagaccattggggatttcacaagggccgccgtgctgtttccattttatatgcgccgcttccagcgcgacggtggtgtcatcgtggcgcatattaaagccacatattgcgcactggtagttataagcgcgtaatacatttttgcgaaataacgggtcgcgctgtttacgggtttgctggagatcaaaacccagctcgtcagcgatttcttcctgaatactctcggtgaagtgcgcttcgagtatctgttgcgccagagtattgatgagttttttattgccggttaccagggcgtagtgctgttcatcgaaaccgcctgcaacgtggtattcgttcagttccttcactggcggttgtcggctgctccctgctgttgagcaacgctcggc

SEQ ID NO: 242 - DNA  (genomic), 31880 bp; double-stranded, linear
gcgatttactggaagccattgatatcccaggcagtgaaataattgcaatcatgctcgcaaattttctgctgttcaagcctgcaagtgaagatccattgctgtgttgagggatcaaaagacaacaaaaacttattgaagaaataatcttctgcttttttgtcgaaataatgggcattgatcttgtctatagctgctgaatcttttccagcctcgttgagatcttcaaaatagccattgaagatgttctggttaacaccgccagtaacataagccttgccgttgtgtacaaaagtcacattacccgccatgcccatcggcgcgtgcgacatcaatttattgctttattcattgtgactgtcttctgtctaccaagctttaaccttcacccatatgagggaagttttaagtatgaggcgaaccatagcatatgcttttatacctgttacaccataaaaatcagacaagttatgccataaactacttttgtaatttgagccacaaatcagggaaattttatttatcttccgtgaaagtcttaactttcacggagttttagaatttacaattttgctggcgtaaaggctcctgtttgtatttctttaaccagctcacccacggtatatattctccatccttcgacttcggcgggagtaaggttaactgcaattttaaggcctggccatgcagcttctacggttgcaataatttcatgttctgagtttggaagatctaacccaggaacaggaggttgaaagcctttatgttgcatcatattaatatcaccatgcactgatggatcagtcaggtcatatatttcattccaggattctgcttttaataacccttgttgggaacgtaaacgttgaatgatagccatctctgcttgggtaacgaatataccttcgtggaggggctgttttcgatggcaatccttgcacagaacaagaaggttttcatggtgattatcatatttgatgccatttttatgatggacatggcacaagtttttggcggttgataaattcacgccacaatcattacaaacataatttgccttttctcgtatttctttagatatttccttccagttttcgacatacccactatttgttttgtcatagatacccttaggcatatgacgaaaacaagtactataatctgaaaaaaactcatttaatgagaatgatttaaaaatctctctttttcgttgtttatcaatacttcctttataattaagtcgttcgaggcaattcatacatacccgtaaatcaacatcctggctccgacctgaaccatcatcaatttcgaataaaccatctatgcggttagttgcatgatacctttcaaatcgatttttatggcgcatttcatcaagagttctgcaccaggcaatatgaaaacgttttcctttttcgccatctacgatagccgcatcataacgccctgaatggtcccgaatatataaaagaacctggcggccatgataagagataagcccgctaccagggtcaagatcttcgatactaacttctttacccgtggataactcaatatctataggatcaaagtcaataggggattcatccagaaaaaaatcgactccttctggtaacattttcttccctaattgaataagttctgaaatgtcgatagataatttcatctcttactcctgaataatctttctaatctgcaactcggcatttgttacaactttgaaggtgacacgacgagagcgattaggatcctccttgccggttttatcaagaatgggatgtgcagatgaataacctactgcggcaaatttacttttaacccattgttggtgtgtcgcgatattttttatgtcataaacgtattgtaatactgcacgtgtacgaccttgcgatagtgccatattattaaaataagcaatatcaggattcgttgttcctgtccagtcagtacttgtgtgaccttcaatgcggacttcagtaatatgttcctgataattatctagaacttttaggtagcgaggaaagaagtcgtcaagaatgagtttaaactttggttttagctctgtgcttcctaagccaaataaaacatccggtgatttaaatcgaacctccagagtctgtttatcgatctctgcatcccagtcttgtaaatcctttgcaaactcaatatccagagcattataaagctgtaactgagcattctcgtaggctacggcaacttctttaattttttctttttcaatacgtacgtagtgcatataagcaatagatatgaacataaaaaccatcatcagcccagccattaggtccgacatggatacccaatgttcattatcttgatcttttttaggtaattgtttccctataatcttatccatgatcgattacccgcgatgtttattagcagaaattaatgcttgtaactgccccataactatttggtaatctttaataagtttttcatagttaccgacaaaacctttgctgattgaaagcagagcattacctaatgattgcatttcacggttcatttcacgttcagttgcttgctcaaaagcatgtaactgctcgttgatggatagagcaaatttttcaattgattctctgacttgagaagtcagccctgcacttgccttatcaaatgatgtctggattgaatcaaacatattatcggcattactggatagttgatggttaatcttttcaccagtcttactgaacatatcaatcacattcgtcgtattttgttccatatttctatgcaattctttcgagtgcgactctagtgatttcaggaattcttcaccactttgtttcatttcagtaattgtttcacctaacgtgctggttagggtttcggaggaattgctgacatcatgtgccatcgaggcaaatgcttgttgtgtttgggtaaccgattgtctgaatccttcggtaccttcatccagggcaacgcgcattgaatctgcattaagaagtatttgctggctggtttgctcaagagatgcactaacatttgcagctccggatttcagcagttcacccacttcagccattttgttctgtatttcaggtaatacggttgtagctttatcgcggatggcgacaaaggtttctaaatggcgggagagttcgctgatttgatgttggttcacctgaagcacttcacgcagttcagacatagccagaggaatttctttacattcttcccaaatccctgcaaccgcagtttttgtttcaaccagggactcgacactttgttgatattgttctgacatctgctcaatttgcgttttataatttccctgccactcaacaagtttttttacagaggcatcaagagctttaaagttttcaccaaactgttcagttaaattttgattaaaatcaataatgacttgtcgcaaagcatcaataatttgttctgtagcaccttttgccattagatctgcaaattgttcaagttgttcccaaagcttattactgaaatgagtgtgattagctaattgtgcctgcgaggaatcgctaatctcagtacgtagtaattttatttgagcaataagagaaccttcactatcaccgttaatacccgagactaatttagtcagagtctggttctgctcttttaattcatgatagatatgttcaggtgtaacagattcagggttattttctgctaacgcacttcgtttattggcaaaaaagaaagcatccattccattaaataaaatggcaaaaaacatacctacaatgcttgtaatgaatgctgtttttaggccacctaataatacggggatgctggtatcaatactttcggtattaaaattgagtaaaccaataataataccaatgaaagtacccagaatacctaatgcccccattaaggttggagcatattctctaaacttactatgtatattttttttgtcacaccaccacgctgataaaaatacgaatataacagcccagatgaaaatattggtgatcagtgtagagtctatcgattgaaacaactgctcaaaaagctgcgctaacattttgatacctgtgtaaataatggatagttgtaatcgtttaaaaaataaacaaaacacacataatttatatggttaagttcggtgtagcgctcatgattgtaacaagttttttcgagatataaatgatttgtctcatttttagcgagttcatcgggttgagcttttttatgatgatagtaacctgttacgaattgtatcaaaggaaggcaggttgcttgtgaaaactccagttaacccacttttgcaatggcttaacatgttttttagtcgccgttcattatccggagctgatggacgggcgttatatgcttaccgttgtactgatacagagtacgaaagtttggcagaactactgcgtacatatgccccccgtagttatccaagaacgatattcatttcctatagcgatgttctatttagcatatatgccgcagagtttatccgccggactcatacggtcggacaccctaaatgggacacaattttagattctattaactggaaagttccgtatgttcatcgacagaagctggttaatgatggcattcgctactggaaaagaaagataagaaacctgggacaagcttcgggttatctgcatacactggcttgtgaaggtggtttgcctatccgcatgattgaaaatgagagcggttatttgattacctatttcagaaggatatatcaggcgcttcgtgggcaatcatctcaatatcctgccgctaaaattgcacaagaattaggcgatacgattcctgtcacaatgcaaaacgaactggtctatgaaatagccggtgaattctgcgagactctctgccgattacttagtgagcatcctcctcatagcagtgatcccgtttctgcattacgtaagctctctccagactggcatcttcaacttccactcgttctccccgaagcgaatgctgcagagattgtaaggcgattactttctcaatcttctgaaatacgcagtgcaagtagtcttcaggttgaaagaatctgggtcgatgttgatgacagttggtattgcgatgcccggttccgattcccggccacaatgcgtacagaacagttaacctctttgtttgaatgccatattcagccggagcagacccgactcatcatttcaggaaaatggaaaaatggcggggcaaggttggcaatgctaagccgttatgagcagcaagattggcgggtcgagttattacctattgcgatgcaaaaactctctggtgcagatgcaatggccgaaatctcattgtcgcttcatgaaggtccaattctgttaggtcacacaattccaaaaggcggttatgaacttactgaagaacttccctgggtttttgaagcgatgaatgagagtgaatcgcagctaaaacttgttggtatggggtctgtgagttccaggctaaatgctctgtttatttcgctaccgaaaaatagccatttagatattagtggagaaggtgagtttgatatcccaaggttgctgaaaaacagtgaacgcagcttaactaaaataagtggagtatttagcgttgttttacatgatggtgctgtttgtacaattcgcacccagcaactttatgattctgcgattgaatattatattaaatcgacagaagttgaactggttaaatcggattatcctgtccatcgagcctggccgaagatcggttggaaaaaggatctgcaatatggcattgtaccggagaaagaacttttttggcgttccattcgttcaggtaataatgcctggtattctgtcgcatcagaaatgccaaaaggacagatagaagtccggcgaatagttaatgatgaggttttatttagcggtaaagttgtagttttaccagcagacttcgatattaatattatacctgagagtgctcagcaaggcattattatgctttctggtataacggatactagaattgataaatattcaaacaatgaaaaagtaacacttaagtccgattattcacaaaacgagtgtgctatttattataattcatcgctgatgctggaaaataccgttgatttacgggtctcctggaaagatggttctaatcttaaactattattacctaagccggttagcggtggccgatttgtaactaatgatggttctgttcattttgatggtgtggcatctatagcacatttgcatggaatagatgctgagttattaaccatatcatgtgctggaagaggatatcttaatatcgagttattggatgaaaatccagtagctgaaaaattccgctatttacatgccgaccttcctcttttatcaggacgcaatgacaaattacaacaaatttcactttatgagaactataatttgctaaatgctatgctggcatgtgcatggaacagcaatagtacattatgtgttgatttttactctgacagatttggaaaggataaagcaacactcaatattaaacgctacgatggtagttttattgaacacgatcaagggttactggttgatataaaaaattctgttgtttttcctgcaaatagaatagacgaactggttgttgatgctatttctcttaagaatcctggcttacacatatcattgttaaaaaaagatgagtttgcttatgatctttcagctctgaatgttcaggatagtccatggttaattgtgggaaaacttgatggtacagctcgcattgcaccagtaattaaatggatgctacctgtattgcagacaaatgatttattactaaatgctctatgcgaagcagacccagaacagcgcaaaaaaaattttaatgagctaatttttgaaatagataacaacccattgcaaaattattgctgtttattaacagagtatattaagaaatacaaaatgaataatggcttatccttgctggatctggacttgttcagaggtatttcgagtaattaccgcgtggttgttcaattgttaatatcatcatgtctttctggtgatagcgatacgatttatgatatacaggaagaattacccttttcatggggatggattcccgtttcaatctggaaagatgttttccaaaaatgttggacttatctggagaaacagattaacgataaaacattagcattacatatattgcaaccctttattgcttttatgaaccatcgtgcacatatcgatcgtcggctggctccgattgcgaatatgttacttacatatagtgagagcctaccaaccggttgtgatgtattgccaactgttagtcgtgagcagtttaatgaagctaaacagatgctattaaggaaccccgacagctttgggcgtatcagtatcttccctaaagaactttggtctagtgctattactccagagttaaaatctgtttttaataagctttggattgaagataaatatcactcacggcttgaaaaacgttttaatttgatgttagtcgcagcgctgttaacccaaaaagataataacctgatacatcaactgtctgcgctttttgaatttcactatcagcaagccccacagcaattaggggtaatctatcaatattattttgaacaagcaggagtatgtcattgatggacgttcagcaactgcattatgcgccacttctaaatcagcttcatcagcgtgcggtgaggtcggtggtaagtcagttggcattgcggagcaagtcgttgactcattatctggaatcacaatattttcagcctcccggtcaggaggggtcactgcttgcagacccggtattcgaaagtacattcggctggatgcctgcggatgaaacaatggaggatttgcgggacaagctgatctccagcccgctggttgatgcattgagcaaagcgccagtgccatttcgtcatcaacttactgcgtggcgaacgattctggaagacaaaaaatccttgttagtgagcagcggtacgggatccgggaaaacagaatgctttatggtaccggttctggaagatcttattcgtcagcaaaaatcgacccgccagtcactaacagggacacaagctattttcttgtatccgttaaatgcattaattaacagccaacaggagcggcttcgcgaatggacgcgcggatttaaggggaaaatacgcttcgcgctatataatggcgaaacccggcataccaaatacgaaattcaggaagatcagttgaaagtacctgaacaagctttgagtcgggaagccatttatgaagcaccaccttccatcatggtgacgaataccaccatgctggaatatatgctgattcgtcgtaaagatgccccaatcatcgaaaagtctcaggggatgttaaagtatatcgtcctggatgaagcccatagttatattggttctcaggctgctgagttagcgctgcttttacgtcgtgttatgcaggctttcaatgttggacccggcacagataaacctgtgcagattatcgcgacctctgccactattggtgaagactctcctgaaggtaataaggagcttgctaaatttgtcgctgatctcgcgggcgttacagaacgtgatgtcaaagtggttcgcggttatcgacaaataccgcgggtatcggagtcgctgattcgtcatgaataccccacatctttaacttctcttaaatccctgagccctcaggatctttaccaacagctttgtcattaccgtgtggcccagcaattgcgtcaggcgttaactcatcccggacggcaggcagtacgtttgagtgagttgctcaatgttgccagaagaacctggccagatattaatcaccgtgagctactgcaactcctcgatctaatggcaagatcgcgagaaggtgaactggcttttacgccattacgtatgcatgggtttatcagaacactggcgggtctatgggcatgttcaaacaaacaatgctcacataaagcacatgaattaaatcagagtgactggccatttggtcaggtatggtttgagcagcgccaatattgtgactgtggagcgccggtatttgaagttttacgttgctccgggtgtggttcagcttatttgtctgccaaagaggagatgcgcggtgatggaacgaactggttggtagcgcaaccagccgctgccgaagtggatgagtttgctcttgatgtagatgtttattctgaagatgaagacaacgacgaattagacaataactctcaatttgatcgtctgattgcgagcgatggtgaaaaatatatcatttcactggaagaaacgacggcggggaaaattgatagtgaagcgcaaaagcactatgaaataaacctgttaagaccggaatctcgaggtgagggacgcaataactcctttgcttgtgtttgctgtggtgacactcaacggaaaaataatcctttattccgtccgcttcggctcggcgcgcccttttttttaaatgaaattattcctactctgctggagttttctccattaccgcaaacaagagaagagcagttaggaccgtttaatggtcgacgcttgctcacctttacggattcgcgtcagggtaccgctcgcatttcagcccgcttacagcaggatgccgataaagcgacgttgcgagctctttgttaccaggagctggcaaatattacagagccttcagcaaaactcagcccggcacactgtgcactgttagagaaagttattagccagttttctgtcctccctttaaaaaattccatcgacgcgctgaaaaaagcgatggctgcgaatgaggagcttagcccgacggacattcaggcacttaaaattattgagccgatggtgagttccttaagcacggagcatgctgaagcgatgcaaatacttcaggctaactctggcaatcagcagaagaaaaccatgtcatggcaaacgctgtctgaacagctggttggcagtgtggaccttgccgatagaatgagaggcagttttaaagaattgtctgggcttgatcttactaaacaacagtttgcagatttttgtttatacagcgagtttggtcgccgccctaaaaatgcctggaccctcgaaagtctgggtctggtagccattcactatccattcattgataaagttacaacctgcccgcaggactggaagacattattacccgatcccgataagcaattagcggaatggcgtaatttattgaagattactcttgatttctttatccgtgaaaacagtgccgttttttacgaaaacgagcaataccctcgctggatgggggcacgtttcccggtaaaaatgctccaggggccagataaaaaaaacaaagggcagaaacgtgatcaactttggccacaaatacgcgatcgccattataaccgggtcattaagctattaatcgcagtctttccggcaatacaacctgagcaggctcactggaaatcgttagttaaccacttaatgattgaggtctgggatgcaattcgaccctgcttacgtcagtttgagtcgggttatcagctggatattaaacaacaagctgaattttacagtccaaagcaagtgtggcgttgcccctatactcgacgtgcgttagacgtcacgttgctgggatactctccgtatttgccgggtagcaaagaaattgcacctgaaaaagcagtgttgattgaaatgcctgagcttcctgtacgtcactggcgtttgtctggtggtggagaaatcgcccgagaagaacgtctggagtggctggaaagtaatgcgctgattcaacatgcccgcgaggaaggattatggtctactcgcagcgaccgactggccctgaaagatagctggtatcgtctggaggaacactctgcgcagagaacgcctgagcagaaccagtttaatgaaaaacaatttaagtcaggcaaagttaatgtgctgaactgttccacgaccatggagatgggggtggatattggtggtatgagtttggtggcaatgaacaacgttcctccagcgccggcaaattatttgcaacgtgcaggtcgcgcggggcgtcgtggagagagtgcatctgctgccattacgttatgtaaaaacacggcgcatggaatggaggtattcaaagaccccctctgggcgttcaacactactgccagtgcgccacgggttcgttttgggagcagtagtattgttcaacgacatgttaatgccctggttttaggtctgtttttacgagctgaagttcctgatgcgacaaaactgagttgcaaatggttctttgaaggtgatgagagccagtgtcttcgttttctccattggttaaatcaccaggccgatcagctggcggataaacttaaacgccttactcagggaaccgtactgatgtcattgacggcaacccagctcttgacccgcacacaagcaatgatgcagcaggttgatatccgctggagaagccaacttgcgatactgttggaaaatatcgaagcgttgaaggcggataacagcgcgtgggaagaaacaccagcaggtaaagccatcgcttatcagcttcgtgattatcgcggtgcatatctgttttctaaactcattagtgaagcgttcctgccggggcatggtttcccggttggcgtagtcaatttcaattatctgacggcagatgagctggaaaaacgtcgcgcaataaaagccactcaggctgaccctaatgaagggggagaaagcttttctcgtcgtattgaaaaattgcccagccgtgatttgcctacagcattacgcgagtatgcgcctggtgcagatgtggtattgggcggaaaagtatatcgttcctcgggcattatgcttggcaaggtgcttgccagcgggcaggagctgtcaggcgatcatcatattccgtggttctggcattgccgtaaatgtggtgcgggggcaaccagtactacccatcctgtcgaatgtagtcactgcaaagcggatatacagcaacttgatgtgaagcgttatttacagcctgttggttttgcgacagatattcgttatcaggcacataatgatgtatccatgcctgcacaacttccctggaaagatccacgtgttcttgtaccgtcttcggtgtgggtttctttacccgatgctgggctaggacgttaccgttttagccatagtggggaattgttccacttcagtgaaggggaatttgggcacggctacgcaatttgcctctcatgtggtcgggcagaatctcaaactcaaccccagcgtacccctgaaaatctaaagaacccagagagggaaaatacgcattacctgttgcgagggggcagtaacgatcgtcaggggagcaataaattgtgccacggtcatgtgcataaagatctgtggttgggatatagcagtcgtacagatatggttgagctgcaactcaatgatgataatggcctgttgatccgtgatgaggttgccgcgcgttcccttgcggtcgctttgcgtgaagggttagcgcataaattgggtatcgaaaatactgagctgggcgtgacgacgcagcaagcgcgcgatatcaatggctataccggatattccatcttcatttacgacaataatgcgggtggtgcaggttatgcagtgcaattgatcgaccattgggctgatgtctttaattacgccagaaaattgctcgattgcagttgcgataaattctgtcaccactgcttgctcagctacgacagtcagcattatgtcaacagattagatcgtcaccatgcattaaccctgcttaccaatgtacggttgcagcgacttaacctcgcgccagaatatcagtacttcggcgatggtagccgggttgaaactaaccctctgagtttacgtattgcgcaatgcctgaacagcgagatttatgactcctgctcgctggttcttgcggggccgcaggaacagtgggactttgcccaatggccattatttaaagagttgctccagtttgcctcctccggtgggaatgttgagttgctggtggccacgccgctggcaaacttaactgatagctccagacatcagctttccgcgttggcggcgatgccgggaggtcgcttacaagtgaaatccattgccactgcgcagctcatgcaaggaaaggggcgctggcttgcgcaggtgactcgcgaagggcaaagccaacagtgggccgcagacgacagcgctaccgttgcacctggtgaattatggggacaaagtgcgtcttcaccagtagtgacacttaaaggaacgtccggaaaaaccttctcgggtcagaccttaagtgcagaagatttactgcccgccttacccaccggggcggtgcgcatcaatctctgtgaacaactggacgggccgctggaaggttttggttcgcgtttctggtcgttagtcacgcaacagcacgctggctggaagcaggcatttacccgccacaaagagataacgcatgttgagtacagcgatcgttatcttaatagcccattcacggcgcgtttgttaggtgaaatcttaaccgagctggttgaacagggaatggcggaacgcgccagcctcactgtttgcgtcaaaaaattggattacaactctcgccaacacgacgctctctataacgcgtggcttaatgaggaagatcgtcagcaggttgtgaccactttacttgaagaaggatatctggggcctgcgtggccgggagcaattagctggttaacgggggataaccagagtacggagcatggacgagaactgacagtcaccttcagcgatggcagtcagcattatgtcctgctcgacatggggcttagctactggcgctgtattgaagataccttctttgattttgccctgcgagtaccgcagcaagttgaacggctggcaaacacgcgagcgcgagctgttgccccgggtaatgaccttaggagttatattatcgctggataaataattgctcccctggggatatcttccaggggagttgacccagctcactttttaataatttttgtttgaaaatcatgcgcaatttatgcgcattccctcccattttgtcactttgccgggggccttcatgatatctttaaggccctcttttttatcgcagtgtgccgcgccacatttttcaggatgacgttaccgccactgccccaaatagacagaaaaaccgatgaataagcaaaattatgcacctggtatgcgggtggttattcgtgatgccgaatggcgtattcgccgggcggatgacagtggtgatggtgggtatttgctgacctgcgatggtatttcagagcttgtgcgcggtaaagaagggttatttctgaccaaactggaacaaaaagtagagatcctggatcccgcaaaaacgcatttggtggaagatgaatccgccaattatcaagcggcacagttgtatattgaaagtcagttacgccaacgcgtaccgacagacagtaaagtccattttggtcatctggcggcgatggattccatgccgtttcagctcgatcctacgcggatggcgctggcacaaccgcgtcagcggatactcattgccgacgctgttggtctgggtaaaacgctggaagccggtattctggtttcggaactgatccgtcgtgggcgcggaaaacgtattctggttctggcggttaaatcgatgctgacacaattccagaaggagttctggagccgttttgcgatcccattgacccgcctggattctgctggtttacaaaaggtgcgtaaccgcatcccaaccaaccacaacccgttccactattttgacaagaccattatctccatcgatacgctgaaacaagacattgaatatcgtcaccatctggaaaatgcctggtgggatattattgtcattgatgaggcccataacgtcgcagaacgtggaaccagttcgttacgcagtaaactggcaaaactgctcgccgggcgcagcgatacgctgattatgctttcagcaacaccgcatgatggtaaggctgaaagttttgccagcctgatgaacatgcttgacccgacggcgatcgccaacccgaaagagtatgaatacgccgattttgccgataaaaatctggttgtccgtcgcttcaaaaaagacgtgaaagatcagatgtccggcgagttccccgagcgcaatattgtcaaattgactcgcctggcatccggtgccgaagaagaagcataccgtcgtctggttgagagccagttccgtgatgatgacgatgaacaggcccagtctaacaaaggtcgtctgttcaagataaccctcgaaaaagcgctattttccagcccgatggcgtgtgccagcgtcgtggcgaatcgtctgaagcgtcttgagagccgtaaagatcataatagccagagccagatcaacgaactggagtcattgctgttggcgctgaataacattgatgccagccagtttagcaaataccagttgctgctcgacaccatccgaaaagacctcgcctggaaagccaataacacggaagatcgcctggtgatcttcaccgaaagtattaaaacgctggagttcctcgaacagcaactgcgagcggatctgaaattgaaagatgaccagatcgccacgctgcgcggcgatcagggcgatacggtattgatggaaaccgtagaagcctttggtaaaacgcagtcgccgttgcgtcttctggtttgttcggatgtggcatctgaagggatcaacctgcatcaccttagccacaaaatgattcactttgatattccgtggtcgttgatggtattccagcaacgtaacgggcgtattgaccgctatgggcaaaaacatcagccccaaatccgctatctgcttaccgaggccagcgaaccacagatcaatggcgatatgcgcgtactggaagtgttgatcaacaaagacgaacaggcgcagaagaacattggggacagttcggagtttaccggcaaatttacccaggaagaggaagaagagcaggttgcagagttcatgatgcaggatgatggtgccagcctgtttgatcaactgctgaacagcaacgtctcggaaagcgccgaacacgatctgtttggcgaaatatgcagtgcggtttccagcgatgcctcaatggtcaccgaaacagacaccagcttgtttgccagcgaacaggcgtactgcgaaagagcattgggttacctgaaagccagtggtcaaactatccagtatgaaaccttgcctgataataccttgtcgctggtggcaccggaggagttacgccgccgcttcaaccagctaccgcctgaaattgccccggagaactggcagctctatttaagtcaggataaaaccgtcatcaccgacgcgattgcgcgcgctcgcggtgagcaacatgcctggcccgatgtgcagtatctctggcaaatcaacccggtagtgcagtggctggacgataaaatctcttcggcttttggtcgtcatcaggctccggttatccggctgccatacctgcttgaacccgatgaagatcacttcattctttccgggttattcccgaaccgtaaatcacatccgatggtgaacccgtggatagtggtgagctttaaccgtgaatcgctaatcggcagtcagcctttcgctgagtttttacaacgtcatccgcagttgagtaacaagctgactaacagcggcggtaaagatcgtaatcaccaacgccagcaggatttactggaagcggctattgctcatgcccgggaggtattcatccatgatcggaatgcgtttgaaacgcacattaaccagcaactgaatgagcatctgcaaaagttggacgttttgcgtgggcggcagttgagccaacttgagctggattttgccgataacaaacagcaattgtcagtcaagcagagccgtaaagagcagagacaacgcgaaatcgaacacaattttgacagctatatcgaatggattgaggacaccatgacgactgaaaaagaaccctacattcaggtaattgctgttatcaccggagcggagggttaatcatggcgctggtcggtattaataacgaaaacgaattttactctaaccactatttgggtgaggttttcaccagtgatatccgcgatgtgctggaaccctggatagcccaggaaaatgcagcgcgtgaagcggagcgtgccgctcgtgaacagggcaaagacgtggagccgggataccgcgctccgtggaaccagtttaacagtctggcgactgagtttttccgcaaacttgccgagcacgaaaaacagcgtcagatcccgcagcgtctggccgatcaacgtaatcgctggcagccattgttaaaggcgctgggctacgaaattacgccacagatccaaatgctggatgacgatacaccgctgccggtactggcgcgttacaacagcactgacggtagcccgtggctgtggattgttgaagcacacgatcaggaagaaggaacgctggatccgctggcgctctccttactgaccgcgcaattcccggcggataccgacaaacataagcacgacagcctgcgcaaaaaagccaacggtgaatatcgcagctggcaggatttgctctctacggcggtcttcacccaaaatgaaccgccgcgttttgtgctgctgctcggtaaccgtcagctattgttgttggaccgtactaagtgggcgcaaaaccgtctgctacgttttgattttgaagagattttaagccgtcgtgaaacggatacgctgaaagcgactgcggtgttgttacataaagattctctgctgccgggcagtggggcaccttatcttgactcgctggatgacaattcgcacaaacatgcgtttggtgtttcggaagatctgaaatatgccctgcgcgaaagcattgagttgctgggcaacgaagcgatgcattatctgatcgaccgtggcctggcaaactatacaggtaatcgtgcggtggacccggatgaactgagccgcgaatgtctgcgttacatgtaccgcctgctgttcctgttctacattgaagcgcgcccggagctgggttatgcgccaatgaccgccaaaacctatctgcaaggttacagcctggaaacgttgcgcgatctggagatgatcccgctgaccagcgaagaagatcgcaacgggcgctacttccacgacagcctgaatatgctgtttaaactggtgcgcgaaggctacaacggcggcgtgaaaatgcagagtgacctggagagcggcgaccggatcaccatccatagtcatcagttcagcgtcccgcgtctggaaagtcatctgtttgatgccaacaacacgcgcattcttaaccgcgtggtattccgtaacgaaaccctgcaacagattatccaggcgatgtcgttaagccgcccggccaaagggcgctttaaccgccgcggacgtatttcttatcgccagttgggtatcaaccagttgggtgcggtgtatgaggcgctgctctcctatcgcggattcttcgccagcgaagatctctacgaggtgaagaaagccggggaagagtttaacgagctggagacgggttacttcgtcagtaaggatgagattagcaaataccacgaagacgagaaggtctacgagaaagacggcagtctgcgcattcaccgcaaaggcagctttatctaccgtatggccgggcgcgaccgtgagaaatctgcctcttattacaccccggaagtgctgacccgctcactggttaaatatgccctgaaagaactgtttaaggagcagattgatcccattagcgatccgcacgccaaagctgatgccatcttaaacctcaccgtgtgcgaaccggcgatgggcagcgcggcgttccttaacgaagccatcaaccagctggcggaagcgtatctgttccacaagcagcaggcggaaggtcgccgtattccgcaggatcgttacacccaggagttacagcgggtgaaaatgtacattgccgacaacaacgttttcggcgtggacttaaacccggtggcggtggaactggcggaagtgtcgctgtggctgaacgccattagtggcgatgcgtttgtaccgtggtttggttaccagctgcactgcggtaactcgctggtgggcgcgcgccgtcaggtgttcaacaagagcgaactgacctacaaaaaagccaaagatccgagctggcttaacagcgagccggtcgaactggcgatgaacacgccgcgtgaagagacgcagattttccacttcctgctgcccgacggcggtatggctaactacagcgataaaactgttaagcagcgttatccggatgacttcaaagcgctggacagctggcgcaaagagtttattaaaagctttgccgggcatgagattgctgatgtgcagcgtatcagcgaaaaggtggaagcactgtggaacacctatcgccagcaacttaaagcagaacgtctgaaaaccgccgacagctacccggtgtggccggcagaaaacagcgagcagacgcgttcttcgctgagcagtaaagatgaaacctttagcggtcgtcttgaagataacagcgcctaccagaagctgcgttgggtaatggactactggtgcgcgctgtggttctggccgatcgacaaagccgatgagctaccggatcgcggcacctggttgtttgagattgaaaccctgcttgacgggattgtaatcacggaaaaagtcactgaagttgcggagcacaccaccggcgatctgtttgccgaagaaggcctgctgcgagaagagtcttcgctgttttctgttgctggtcgtctgaaaaccgaggtgttgttccgtcatttgccgcgtctggcgattgtcgatgccctgagaaagcagcaccgtttcttccactgggatctggagttctgcgacctgtttgccgagcgcggcggttttgacctgatgctcggaaacccgccgtggctgaaagtggaatggcaggaagcgggcgtgctgggtgattacgagccggaatttgtgctgcgtaagctgagcgcctcgaagctggcaacgttgcgtattgatacctttaaccagatcccggcgctggaagcggcctggcgcagcgagtatgaaggctgtgaagggatgcaaaacttcctgaatgcgcagcagaactacccggtactgcgcggggtgcagaccaacttgtataaatgctttctgccgcaggcctggcgattaggggcgcagaaaggcgtggcaggtttcctgcacccggaagggatttatgatgacccgaaaggcgggcaattacgtgcggcggtatatccgaggctgagggcgcattttcagtttcagaatgagttaaatttgtttgttgaagttgatcaccatgcgaagtttagcagcaatatttattctgctagccctagcacagtgggatttgaacatatatctaatttgtatgctccgcaaactattgatgcatgttttgaacattctggcagtggggacattcccggtctcaaagacgagattgagagcgagggaaaattaaaagttgtatggaacacatctggccaccgttctcgattaataagtatcgccactcatgagctagaattatttgctcgtctatatgacagcgaaggaacgccagcctggcaggcacgtttgccagccttacatgctaaacaacttgttgctgtactggaaaagtttgctaatcagccgaatagattaggtgatttgcaggggcagtatttttcaacggttatgttcgatgaaacatatgctcagagggatgggacaattttacggcagactcaattccctcaagattcatcacaatgggtactgtctggccctcatttctttgttgggacgccgttctacaagactccgcgcgaaaactgtacgcttaacagcgattatgactgcctggacttgctaactctgcctgacgactatctgccgcgcactaactacattccggcatgtgatgcacaggagtatgcaaaacgtactccatgcgttacatggactgaactggctgaagatgaaccgaagaaggtaacagattattatcgcttagctatcagagccatgttggctcaatcgggggaacgtacactaattagtgctatttatccgccagaaataagtcacatgaacgcagtacgttcttactgctatagctcacagaatctgttactcgaacattcaggtatgtgtttttctttaccttttgattttatttgtaaatctactggcaaggcaaacttacatcagatgcttgatggtttctcatacgtattattcaatccgagacaaaaggcattattatactgcttagtattatcattaaattctgtaaatgatgtatatgctggcctttggcaatcctgctacaccccagacttcaacacccagcgttggagccgcgatctcccgcagctcccccaggatttcttcgccaaactgaccccagagtggcagcgtaactgcgctttacgctctgactacagtcgtcgtcaggcgctggtggaaatcgacgtattggtggcgcaggcgctggggttaactctcgaagagctgcttaccatttatcgcgttcagttcccggtgatgcgccagtacgaagcggatacctggtacgatcaaaacggtcgcattatctttaccccaagcaaagggctggtgggcgttggcttgcctcgcaccgcgcgtaaagctgacctgaaaaacggctttgtctttaacgtcgacagcccggagtggaccggcggtgactgcaccgatcaagctatcggttgggatgatgtcaaacatcttaaaaccggtaccgtcagcgtcacctttgatgattatacccgcagcgacgaaggtgagcgccgtaccgtcacctggcaggctccgtttatcaagccagatcgcgaagatgactacaaagtggcctgggcgttctttgcacaagataaggagagcgcctgatgttgccgtccgttgtcagtcggcaggtcgccgacagcgttgccgcctttttacgggcggcgttcccgctaaacagcccgctgtttaacggtgagaataacgataatgtctcaatgctggagcaatttctggcccagccggaaacgctgctgaaaggaccatacctttccgcccagttgccgtttcgtaaaagtgacttaccgctgaattttttccctaatctgacgctgccgttcccgccgcacgcgcatcaggcccgggcatttcagcgtctgggaagcgacgcgccacagccgacgctggtcgcaaccggtaccggctccggtaaaacagaatgttttatgttcccgctgctcaaccactgcgcgggcgcgtcacaagccggggttaaagcgattatcatctacccgatgaacgccctggcaaccgatcaggccagccgtttcgccaaaaccatcgccagcgatccacaactgcatggcaaggtgaccgtcggcctgtttgtcggcgacagcgaaatcgaacccagcaaaaaaatgtcggcagaaaaggtcattacctgtaagcacacgctgcgcgaaagcccgccggacatcctgttgaccaactacaaaatgctcgactacctgctgatgcgccctggcgatcagccgctctggcgttacaaccagcccggttcattgcgttacctggtcgtggatgaattgcatacgtttgatggcgcgcaagggtcggatctggcctgtctggtgcgacgtttgaagcatcacataggtgtggataaccaacgattcgcctgcgtcgggacatcagctaccgtcggcgacgaactggggcaactgctcgattacgcaaaaacaatctttgaccagccgtttaccgatgacgccgttattcgcgaagatcgctacacggcagcggagtacttgcagaattacgccattgcgtacagtcagtatccggggccggaggtcgcttcggccctggacccgcagagttacgctaccccggtagcgtatcttaacgggcaaatccctttgtggttccccgacagcgacttgcaactcccggacgatctggagagcgacgacgggcgtgaaaagcgtattgcgctggggtcactgttacgccgccacagcgtgatgcatgtcttactccatgatctgcaaggcgggatcctctctgaacgagagtgtctggaaaatctccaggtcatgctggcagaaagcgccgaccatgcccgacgcgtgctgcaaagcattctggcactgatcgcgcaggcacgtctcgaagtaccggaaacggaacacgatcggcaaaaacgtctccaggcgaagaaagcgcgtccggtgctgccgtttgtgcaactgcgctcccagttgtggcttcgtgagatgcgtcgtctggtcgccagcgtggcgaaaacgccccgactggtgtttgccgatgatgtggcggtggaagatcgcgaacactatttgccggttatccactgccgtgactgccacgcaactggctgggccagcctgcgtcatgggcaaagcgttcagttggaaacagacctcgacggcatttatcgccagttctttgaaaaagggcgctccatcgtccttgctttcccggataacaacgaaaaagcggtcagtggcgcacaccagaaactgtgtcctacctgtctgaaactgaaccgacagtccagcgtccagtgtggacattgcggtcatacggaactgttgcaggtactgatcccggatatgctcaaagagcgtaaggacgagctggagtttgctaatgaatgcccgtactgcaacagcaaacaggggatttcgattctggggtcacgggctgccagtctgtcggcggtgatgattcaccagctttatggcagccagttcaacgaacataaaaagctgattacgttttctgactcggtacaagacgccgcgcatcgtgccagcttctttactgcccgtacctggccgctgatgattcgtgggcaaatcgccagtgttcttagcgaaaaagagacattaccgctggatgcgttcgcggcgcgtgtttgccaacaaacgcgtgaacgttcaccggacgatgctcattttgcagcaaacgtcatcgcaccaaatatgcagtggctgaatgattatcagacgctgaaaaatgaaggcaaactggcggagaactccgatctgccggagctggtttccctgcgcctcgactgggaggtgtacagcgaatttaccctgcgcgcgcgtatcggacgtacgctggaagccaccggttatgccgttgccggagtggataaagatcgcttcaatccggcaattaccgccctgcatcaacagctttgtgaagagctgggtgatgagatgtctggtgtgagcgtcgagcaggtagcgcacctggcgctgggggttatctggtatcaacgccaggccggggccgttatgcatccggcgttcgaaagttatcgccgtgatggcacgacctttatgatgacgcaaaaagagcgtacctcgcgctatatgccttctatcggtccgaaaacgcgtaaaccggcttatgcgtcgtttgaaaaaattaatggtttccatcgcctgattggcgcgaagtctaaccccagttggtatcagcattggatcaatcgcacgctgagtaacggcaataatctgtttatcagtagcgttgcggaaacagtgttacgacgcctgtttacggcgttgaaaatagccggagtagtaaaagattttgacaccaaagggcgtgaagcctggggactggtgccttcggcgctggtggtgagccgtgacgtcgttcagcttaattgctcatgttgccgtgaggttgtccgggctccggccgatcaaggctggcagtggcgtaatgcgccttgtctctctttacgttgtgaaggtcgttaccaggaagtcgacaatacggcgacctggcgttgggagaacatggacatcgcgcgcgtacagggcgcagaacacacggggctgcttagccgtgaagatcgcgaagtcaccgaaaaatcgttctaccgcggcaaccaaccgtggaatatcaacctgttgtcggcaacaccgacgctggagatgggtattgacgttggggatctttccaccgttttactctgttctgtcccacctgctcaggccaactacttgcagcgtattggtcgcgccggtcgtaaagatggtaacgcgttaaacattaccgtggcagaagggaacccgcacgatcagtttttctttgaagaaccactggagatgatgcagggccaggtgcaggctcctggcgtcttccttaatgcaacggctattctcgaacgccagctggcagctttttgtatggataactgggtgaaaaccggtgtaccagaatccgctatctgtaaaaacgtcaaacagatgctggatgagctggagttcgggcgtaaatcgggttttccgtataacttactgcgatatatcgaacagcatcatgcggagattgctgcgcaatttacggcaatcttccccgatcttgccgcagaaactcgccaacagctgttgtcttatcttcagggcgcgccaggacaacgctcgctggtgcagcgtatcgaagaagcgttaaaactgctggtggaagatcgcaaatctttgcgctcacgcatcgataaactcaagcgcagtatcgataaactggagaacgcgccgcgcgatcaaaactttgatagcgatatgcgcgagttaacttcggaacggcaggcgctgatggcgctggtcaatcaaatcaacaataagcaaacgctgaatttcctcacggatgaaggtctgctgcctaactacgccttcccggaagccggtattacgttacgttctgtgctctggcggcgtaaagaaggcggggaagcacgtgaatatcaaaacaccactttcgaatatgaacgcccggcatcaacggcgctggctgagctggctccgctgaataatttctatgccggtgggcataaagttgaaattgagcagatagacctgaaggtctctgagccggagaactggcgtatctgtagccactgtaactacagcgaaaatatcgaccagacgggcgaccagcataaatattgcccgaaatgtggcacaccggggtgggccgatgccggacaaaaaaccacgctgctgaaacttcgccaggtttatgcccgcgccagcgcacgtgatagccagatcagcgacgagagcgacagccgtgaacctgctttcttccagcgtcagctattggttagtttcgaaaaagaagatgtatcggcggcatacgcgattgaggaaggcgaagttccgtttggttttgaatttttaagcaaagtcaccctgcgggatatcaacttcggcaaaatggcggatgatgccaatgagttgatgattgccggagaagcgaagaagcgaaccgggtttaaagtttgcctcgggtgcggcatggtgcagcgtcctcgcgatcatgaaccacgtcatgatttgagctgcaaatatcgcacggaaccggaaaaggcgaagttcgaagattatctctacctctatcgccagctggagtcagaagcgttgcgtattctgctcccggtaagcagttacagtaatgaccgtgtcgtggaggcttctcttggggcggcgatccagctcggtcttaaacattacttcaaggggaatgtcgatcacctgaaaggcgttgtgtaccgcgagccggaaaatgaaggcgaatcctggcggcagtatctggtgatttacgataccgtcccgggggggactggttctcttaaagaactgatgcgcactcccgacaatttgctgaaattacttgaactggcctatcaggcaatagtggaatgcagttgcaacaatgatacgcataaagatggttgttatcgttgcgtttacgcttaccgtgaccgtgggcgcatgaagtatgtctcccgcgatcaggcgcgtctcttgctggcgaaaattttgcaggcaagagattcgatacgggtaattgattccatcaaaaacatttccctcgaagccatgatgggcagtgagctggaaaaacggtttattagctgcctgcaagaaaataaaaacctgattgtcagtcgcagttacgcgcatcagggcgctgggtggattattaacacccgcagcgaaccgatgatgagctggcatcttaaagctcaggtggatttaggcgctaaagaggcggtggggatcccttgtcgcccggattacgtgctatatccgcttatgcagtctgatgccattaaaccggtggctattttccttgatggctttgcgttccacaaaaatagcgtcgcagaggatgtgcaaaaacgccaggcgattcgggatagcggtaatttctgggtgtggacagtcacgtgggccgatctcaaagagccagggcttaaacatgttcaggatgtcctgggacttgggcataacccggatatgaaacagcctaagttttataacctgtttcatgataccaactttgcggcccttgaagcgtcgttccgggaacgcaacagttttgcactgctgctggattatctcgccgatccgggcggaagaacgcagttatggcagagaatggctgctgcacatgcctgggtgtggttggatgtgaagaagtcacaggacgcgggaacgaaacaaaagtatgcctatgaaatgcaggaaaacgcgccagcttggcggctagcagagcttttgccagacgaaccgtttgtctttggtggtttactcgatagctgtaactcatcgcagcaatttattgagctggcttcggtgttaccacaacaagccattaaaccgacgaccagcgtcgcacaaatgcgcagctggctgcgtttgcatatctgttttgacgatcgctatacgcaggatgacggttatgaagcgggactcaatggcttctggcgactggtaaacctgttacagttcctgccggatatgacctttaccagccgtaaagccgtgcatttaccgcaggaaagcgttgacactaaagtttcggcaacgccagaggcagtaccagagactgatgagagttgggctgagattattgagtttggcttattaagcgctgaagagatcgcgttgcttcagtctcattctctctctgcgccgactctcggctacgaattgcaaaatgatgaaggtgaaattattgcggaagccgatctcgcctggccatcacaaaaatgggcattgattattgataatcaagaatttattccattattcacaaccaggggttggcacgttgcattcgggccaattgacgaaaatacattgcaacatctgtccggaggtgacaaatgacggtgcaaacgcccaaggtggcactttctgatggttttctgggcgcattcgcgcggatcccaaaggcacagcaaaaaaaggtgcaggaattcatctccaaattccgtcaggacccgaccagtaatggacttaactatgaaaagatccacgatgcgcgcagtaaaaatgtccattcggtgcgaatcgatcaaacttatcgcggcattgttctgaaacctgaacagggtgccctgtatatgctgatgtgggtggataaacacgacgaagcatatgactgggcgcggcggcatgattgttcaattcacccggttaccggcgcgattcaggtcattgatattagctatatcaaaccggcagcggaaacagtggttgataaaccgaaactcttcgctgcttacagcgcggaacagattctggctctgggtgtgccgcctgtctttattgatcaggtgatggcgcttaccgatgaagccgggcttaatcaacttgaaagcataatgccagcagaagcctgggaacctctgcactggctggcagaagggctggattaccaggaagtgctggaagagtttaacgatcatcgtgatgagcctgttgataccaacgactttatggaggcgattgaacgaagtaaacgtcgcttccatgtcgttgaaaatgaacaggagctgttgcagatgcttaatgcgcctttagaaaaatggcgtgtatttctgcatccgagccagcgaaaattggtggagtcgcccgctaatggtccggtacgagtactgggcggtgcaggtacagggaaaacggttgttgcgatgcaccgtgcgcggtggttatctcagcgtctggcagataaacccggtaagaaagtacttttcacgacctttacgcgtaacctggcggcagatattcgcgctaatctccagcggttgtgtacgcgagaagagatggcgcgtattgacgtcgttaacattgatgcctggatgagcgaccaactaaaacgccacggttatgatttccgcgtggtatacgacagcgatgaagggcgacgcaaatgctggaactatgccttgcagcaggcacctgccgaactggggctacctgataatttctatgctgaagagtggcaacgcgttgtccagccaaatgcggtttacacccgggaggaatacctcaaagtcagccgggttggacgtggaacagcgttatcccgtattcaacgggcgaaaatctggccagtctttgaagaattcagagcacaaatggcgcgtgccaaactgcgcgaaatgggcgatgccatgcatgaggctattgttctgtttaaagaaaagcaggtccaactaccttatagcagtattgtggtcgatgaagctcaagatatcggtgccccggcatttactcttattcgcagcctggttcccgagtcgcccaacgatctgtttattgtcggggatgggcatcagcgtatttatcgcaataaggtcgttcttggtcagtgtggtattaacgtccgtggtcgtcgcagtaaaaaattgaagattaactatcggaccacagaagagacgcgtcaatttgctgttgggctgttaactggtgtgaaggttgataacctcgatggcgaagcggataccagtaatgattatttgtcattactgcacggggaaaagcccatgattacgcatgcggcagatttcaaagaagaggctgcaacgctcgtcaagcaaattcaggcattgctggcgaatcaggttcgttctcaggatatctgcattactgcgcgtactaaacatgcttgtgaccgctacgcatcagcactgaatgacgccggaattgagacatttaatttaggcaatgatagcggtgacagcgatgcacgccctggcgtgcgggttgcaacgatgcaccgtattaaagggcttgagttccagtatgtgttcctggtggggattaacgaaggcgttgtgccggaaataaaagcattagcatccgatgatcccgttgaacagcgtgatgcattatttaatgagcgcgcgttactgcatgtggctgcaacccgtgccgtaaaagggctgtttgtttcatcatctggtgtccctagtccgctattagtggctgactgataatatgtccaaaacaggccaggagccgaaacgctcctggtctatataaccgttctggcaactggcgatatttatattgcttagctcccaacagccagacaatatcaacttagaaattatattcgcttatgcggtttgcatattgcacagtacaacctgttttctctatatctaacgtaacgtcaggatgtggatgatttttggatggggtgacacactggacaaatatagctggcacgaaaaggctggcatttccagctgaccaatagtctctggaaccatgatgatgataaaataaatatcttaagttttaaacgtatgatgccaggattaccagaattataaacgaatatattagttcttttctatttgttcaggaggggtataaaaattgcaattgttaatagtatcgtcaggacgataaaaagataatcatgacaaaggcaattgaactaaaatgattgacattttacaggtggtttgtcagtgatttcttgttattcataatttattttccgtaaaaaatagtaaggtgatcacctgaataaaggtaatctcatattttgatgagtatagtgattttttatttctctggtgaggaatgaaggaaatatcaatggtaaggaacgtcagagaatcagggaaaattaaggtccctcagaaacacaatgccgttcacttaagcggggcggcactgtgtttcacaggataacgggtttttgatatcttaaccgccctcgcccttgatggtcgggggcgttttgttatgaacaccacttccagagcccccgcagatgctccagtcgtttcgggatagtccccggtgacgccgtgtttcccagcactatcatttctgtcacgataaactggaacgcgaacttaaagctgatctctgacgccgcttttgttgcctcacgccgtatcgctccgccggtaggcgcggtcatggcattcagtagaatgtgattcccagattcattaacgccaccagacgcatgacggggtaggcgctctgccgctcagtggatgtgttggcagagccataatattcacgcagctcgggttcatcaggtgtcctgaactgtgcgccatcaatggcaaaaagttgcaggccgtgccagtcatccttcaggtaacgttccgcgccccatgtctgtgtggtctggcggaagagccattccaccggggcggcccccacgcgctgacgcgcctgggtgacagcgctgcgggcgccagcaggttcatccccgcttcgccatccacgctcaggttaagacgacgaacggtcgcatgagcagaaagcgtcaggaagtgctgtatccactcggtgggaaggtgctctgcaaacagttgcgtagagggtggtggcataagcggatggtcactgaaagtggtataagaaaatggctccttgttgtggaagtcgttatagtgccgcacgccggaggagttaaaagcgctgatggatgcgaataaatcaaattaatgaac

SEQ ID NO: 243 - DNA  (genomic), 5629 bp; double-stranded, linear
gtttatgccggctggggtacaaaaacaataaattcaatatattgcaggggttatataggcctgataagcgcagcacatccggcaatgtagcgtttgttatcagtctgaaaggataccctcgtaaaagggtatcctttaataacaactgctgaaattaaagtgatttacggcaggcggtcagttgggggctggaatcagcgtcgcttccggtcataccggttagcatctgcacatagtagtgccgactgtaatcatcagattcacttgtccagtaagctcccggtgtaaattgcgaattactggaaaacgctccaacgttcccccattcaccatacagtgatccctgcgtgcgtttgttttcgccagacgtcaaatgtgtgatgccaggaagattatatccatcatttttagcatgacagagcgcattggcagctagccagatattggtatgatttccattattcacccaccagcctttcagcttaattaaggtctggtaggttgtacctccttgtcggggaacagcgcttattgtgactgacgtttgatcgccgatatttgcgaaagaaactttacccgaagcatcgacagacacccaaccctgtgaacttgaaaacatataatcatcaacggttttacccgcttcaaagttatcattgttgagtgtgtaatacgctcctgcaaagccttcgctcgggaatttagccgtggagaaggtatggttgtttgcagtgacatgaccggacatttcttttatcgattggatgagattcagcgatatgcttaagtttgcctgatgaaccccgttcagcatgggaatgagtgtcgctgttccctcttttccgccagtgacagtcacggtgtactcgccataatttctttggctgtaatcaatatcgctcaacttgagaaagttcacgaaggggcctgactggacaaattccagatgatcagacgtcactatcgggttaccgtacttgtcttgcaatgttagcgtaagttttgcgctctgctggtagtcagccttcagagtgtcaacatcggatttcaaaattgacttactttcatcggccgtgccggcaaccaatgtaatggttgcggattggttggctgtgccaggaacttgcacattgactgttaaggtttctgccaatgtactggttattgtcgccgtgacttgcccggactgatcggtacgcgtagttggaatattaactaccgggctgcctttggtgtctaagccatgactaatatcgacaccttcaaccgggaatccgtaatcatcttctactcgtgaagtgatggtgctgctatcgatgccgtcggcggtgatggtgtcaggagaagccacgacgctcacaacatgtgccgttttagcatctgccttaaccgcaaccgttacctggctctgaacgggaacatctttgcccattatggccgtaacggtatagacattcactttgtcactggtcagcgtcactttggcctgacctgactggtcagtaaggacttcccctgtattgcttagcgttgcaccttcaggcgttacgctaaaggtgataatttgccctggcatcaattcaccccgcgcatttctcgccgttgcggtcagcgtaataccctcactattatggaccgtagtttctggtttcgatgatgttaactcgagtttgccatttgccacattcacgtcaaccttactactactgttattgtccagcgttgccgtcacctgataaaccccaggttgggtgctgagaaggttaacgtacgcataaccgttattatcggtgtaagccgtatcgcctatcgtaatgttagttgttggctgcgcacttaatctgacgcgttgacccgcgattacattgttaaacgcgtcctggacgagtatccgtagcgtgatgttttcgcccaccgttatcgttttttcggctccggttatacttattaccttcgccgaactttcatccggtagcactgataaactaaacgttttattatcggaagcttgcgctttccggctcaccacgacgttatgttgtccggcaatattgctggtcattgttaccgtcgcctgacccagcgtattggtggtgacttctgtttcgcttagagtgacatcgttactctggaaagtgaccaactggtctttaagcggattttggtaagcgtccaggatcgttgccgtcagggtactccccgtactgttacccgcaacaatggaatttaatgaggcagtcagcggctggagctgcgcactgtttgtatccccaataaaagtgacttgctgataagcaacggtattatttctggtcagcgtcgccgtaactgtaaactcacccgcttttgtgcctcgcaatgtgaccacggcatcaccgtttgcatcggtgcgggcggtttcactacttagcgtgaagttcccggtcatggaggctggcaaggtaaatttcacatcctcatccggcaacgggtgtccataaacatctttcacactggcagtcagggtaacgatatttgtattgttagcgatcgcactgcccgacccggcattcaaggtcattaccgattgttccctgtttgggaccacggtgatcgtgaccgactggtgaatatttttatccacctcaagcgaggcatcgacggaatagctaccagcttttgaactggtcaggtgcacccgcacaataccggactggtctgttgtggcggtcgtgttgtccagttgcgagccaccaggtgccacaaaattcactttcatatcttttaacgggttgttatgaaagtctgtgatgatggcggtcagagtactgccctggctgttgccagcaataatggtatctggatcggcaaccagttgtttgaattttggcgtactcgaatcgctaacgaatttcgcaattatccgttgtgaaaaaccatttggcagcgtggcgctaatcgtattttcttccgcaacctgacttaccatgtttattgtggcaacaccatatgcatccgtattttgctgcggcggttcgacaaactccgcgcttcctttttcattcttaaaggtgacctgatgatttgtcaggggattatcactctcatcagtgacgttgatcgtgagggtattaaatgtctttttatcggcgtaaacgtcattatttgtcgctgataatgtggcaacgcgagccttattctggtttgcctcaatgttataaatatgcgattgcagtggagcattccagttgtgaaggctaagttgtgcccttagtgcagtcccttgcttataggccggataattcgcggcataaacccccggctgctcttcgtgccagacaatcgtggcgccaggtttgctgttttcgacagtaacggcttttaccaattcctctttttgatatgcaaccggttgattgctatcgtctttcagttccaccctaaccttgatgtcgtctccggcataatacgatacgttatcaattgttattgatgaatggtcgcgggatgagacaacagggacgatattaacgacgatggattcttttaccgcactctcaccgttaatttgcggcgtcagtgttactgaacctgatgtcgttccggcggtcagtatctgtgtgtaactaccatcaccgttatctgtccagtcagacagggtgatatcctgaacgccttcactgcgggtttgcagcgccagccccggcaccggagttccgtcggaatcgtgcgcagtaacggtcaatgtggtcgtcgattttttatctgcagccacggttagcggattgacggataacagagaatctttctggcttaatgtcggagcctgaataactaccatgctttgttcatgccgtgacaggttaccttttacatcctcggcggtaacgtctatcgaccatgtattatcggtttctggggtgttagtgaagcggtaacctggcagcgtgaccgtgatatcttttccagacgtgctgactttacctccggcagcttccagcgcagcggcttcgatgttatagcctttaagggcatatttggtctgtagcgaggaaaccagcggttttatttctccagacttccctttcaccggatccagcagactcaggcgaatcagctctttcttgcggtattccagaacgatgttgttgttgcgatcaatcaggtcataacgactaccggccagactgcgccgtccggccacttcgtccggattaagctgtttctgcattgaactgctgggttgccaggtcagatcaacggcaaaacgtgtgtcattttcaccttgcttcccctgacgctgttccgcactgagagtcagaagcgggaagggggtatagttgaggcctgcggtaatagcatgggggttactttgacgatcattcttgtcaaacagcgccacttcatcgccatagtattgttcatagaccagttttccccccagttgtggccaggcaggtaaccagccttccgcgcgtaaatcccagccgttggccgggcgggcttcgaagtcgttatccaattctggtgcgctacgccagccggtcaggccgatataagcgttgctgctcaacttcagataatcacgccagtattctgcgccaagccctgcgcgggagtgatagcggctcaggtcgtggtcaaaaaaaaggttgatgcctgacatccagctggaggtgaaatgacgccagcccaaaccggtgttgatctgggtacgatcgtctgttcggtgaagggtatgctggctgaagagcagataatcaggtgtgtcataccacggatgcaggaagtcgaattgcgaatttttcaggctaaaatcttcatccacacccagagagattctcgcagtaccaaagttatttaaccaatcagtcatcgcgcctgaggcttctgaagacgcccaaccacgcgccatgccgctggcctgctcactattcatatcttgtgaaagcagagtgccaactcgctgcgaggtgctggctatttgattctccagcgtgttttcgccattcgcaggcggtacggcattttgttgctcatggcttttctgcgaggttgttgccggaacatccagttcttcaccctggcgcacgttatcaaagccgcgagcaaaagtacggaactgattaagacgacgaagctcctccagtgaaataccgaagcgattagcaacgctttgcgctgattccagcgcaccaagcgtgtaaggcacagtattattttctagtagaggggggggcagatgaaactgtcgtctgaggtttagcatgtaccacattttgtgccgtcgccatgacggggaaaaaaaattgtgtaaataaacaaactccggcggtcaggcggcgtattttgtcacccagaccacataaagagttttgatcattattttttatttgatgcgcatttgtcgaagccatagtgaccttccgtgaaaaaacagaattaaacttgttttttctagcacggagatataatgcgatcctgactataatatgaccagaaataatgaattagccgtggaattgctaaaccaggaataataccggcggtggctgagtacctccaaagaaaaaggatattttaattattttacgtgatgtgctgaaaagttaaattagttaaattacttaagaataattcgtatgcaatt

SEQ ID NO: 244 - DNA  (genomic), 2797 bp; double-stranded, linear
tattgctccttattattgcttttttctcgtcaaattcagtgcgacagataaggagtatacggatgaagcttaatgaattcttaacgcgggcgatgaaatagtaaacgccgcagggggcggcggttgtctctggatggcagaacattttcagcttacatcgactgataaatgcgcctcatctatgaatgatagatgaggcggttaacgtttaaatgttaatctatatcgtctgccatacccactctgtttgggtgattaatgaactattcttcaactatatatgttggctgataagacgttaaacccggaatggaaaatctcctattcacttctttctttaaacgggcttgattaaaactgttactgtcctgttgctcggtactgttcttggcttgtttatcggtactgtcattgacctgtttatcgatattgtcattggcttgtttatcggtactgtcattggcttgttgcaccgtactgtcaatggattgttgcaccgtactgtcattggcctgtttatcggtactgtcaatggattgtttctcggtactgttattggcttgattcacgatattatcattgttcagatatgctccctcaagatagacatttttcgctctgacattgtaaaaacaggtatttttaaaaagcgtttttataaatattgtattgtcaaaccatgcgtagtcaaataggatattcgaacaatttgcaccagtacaattagtattgtagaattttgcattcgaaaagtttgcattagagattttacaatttgttaaattagcgtttgaaaagttggtatacatgcagagaataccagtaagattatattctgaaagatcttttcccgatagatcggaataatttagtattgcgccagtaagaattactttaggtgttcccggtatttgaggtgttccaggtattccaggtattttagatgtttcatatagaatcacggttgtgaaatctatgtgttcaagatacgcgttactaaggtcacttccagtaaaggttacgccagtgagaacttttccgttgaagttactgtttcgtagatttgcgtttttgaaatttacataagtcaagtggcgaactttacgaaaatcattattttctaatgaggcattttcgaattctgcattacgcagatcacaatcggtaaaatccacgccttcacagatcgtaccggagaacttggcatttctaagaatgctgccattaaaattgacattccttagcgccattttcgacaagtctatgtcggttaaatccatctctgctaaattcaacccttcgatacaccgttgacccgttgcatcttcaggaatagcagtgctaatagtattgatgacaacatcacctatcttgaaggtcattgtaattcctgcatcagagatagagagttttcgcgtaagacgttcactcttatctccagtgatactcttctgagcaacgtaaaagcgctcgcatgtctcacaaaatcttttccagctctcatttggggtcagattattgtccgggaggaaattagcaatgctataaagatcgttcaggacgctacttcttatttcaggagaggcgcattcaataatttcagaggtggatattgtatttttaattttatctatattatccgtgagatttcgtgatcctgctatatttggctgctggtggttttctttgtagtattgcagcaaattttcccattgtaagtttgtaaacgagaaagtttcagtcttgttattgttatcccgtatggttaattgattttctactgggtcaaaagaaatcatgaagttattcaggtgttgatattgatgagtggcatctaatttcacttcaaatgaatttgaacttttgcaggcatgttttaaaaacttttcacagggaaggtgttgatctttatctacttgttgtgggtcattgtgcaaaacagagaaaatactctctttcaaattgttcttgtcaatatagattggtagttgcgctttttgttccattattttaataaactgctgcagttgctcggttttaacattgcagtgatgacttatatctttatctttatctttatctttatctttatctttaacagttaatacgctttcattatcatcttgtcgattaaatattatttttagatcgccatcgtcaaactcatgtaaaccatttcttttggttctgccgatgatttgttctgttgttgatgaatatctatttaaggttaattcaagattgtcgggattagagataaggtgaataaaaagattcagtacacgcttaatcaaaccatcattcaaatgatttatatcataattaatttgtttttgtatggtttcaatttccgtgttaatatcaaatggtaggttgtttttttcatggcaagcttttagtcccgaatacatgccgagtgttgggaaaatatctttgtatatgttaaatagggagcccatatttttatccttgaactgtgaaatattcttctaaatctaaaataatcagggggtggggaaagataagctttgcacagaaacttatcttttaacattacaacacccggtaatcattttatttctctatgcatgattatgggtttaagtataattcaatgtatattgtattttagacgcgcaataggaaggtgctatcaaaaatcgctcattttgtggatgggaaatatttcacggcaggcgagatatttactacaacttccttcatgcaggattatgcgcagccaattatccggttggtatatttaaagatcctattgcctggttgacgcttctgcatc

SEQ ID NO: 245 - DNA  (genomic), 25 bp; double-stranded, linear
gattgcagagcgaattcataatgat

SEQ ID NO: 246 - DNA  (genomic), 2235 bp; double-stranded, linear
atgttcgtcgcggataaacaggatttctctataacctccataaggaagtggttattattgcgaaatcatcgtttcacggaaagacgtcagaatgaaagctacagaagctcgcctactcgattttttaaaacgttcgcagcagtttgttattcccatttatcaacggacttattcatggacagaacaacaatgtcggcaactttgggacgacatcattcgtgcaggaaagcgtgacgatatatcagcgcattttatcggttcggttgtttatatagagcagggattgtatcaggtttctggtatttctccgttgctggtcattgatggtcagcagcggctgacgaccgcaatgttgctgattgaggctttatcgcgccatcttggcgaagacgaagtttttgatggcttttcggcaatgaaattgcgtaattattatttgctcaatccttatgagtccggcgagaaaggttttaaattactgctgaccgagactgataaagacagtttactggcgttaataaaacaaagaccaatgccagaaaactattcccatcgaataatggaaaactttactttctttgatgaacaaattgccaaactcggtgatgacttgatccccttatgtcgtgggttagcaaagttattaattgtcgatgtggcgcttaatcgtggtcaggataatccgcaactgatttttgaaagtatgaactccaccggtaaggcgttaagtcaggccgatctggtgcgcaattttattctgatgggcctcgaaccagagcatcaaacccggttgtatgaagatcactggcgtccaatggaagtcgcttgtggtcagcaaggttacagcgaatattttgacagttttatgcgtcattatctgacggtaaaaacggggagatccctcggacagatgaagtctatgaggcatttaaactccatgcccgcagccagagtgttgctgaaaaaggcgtagatcggctggttgaagatattcatatctacgcggagtattactgtgcaatggcattgggaaaagaaagtgacaaatcgcttgctacggcttttcaggatttgcgcgagttaaaggttgatgtggcgtatcctttcttactggcgctttatcatgactataaaaatgacgatttgtctcacgaagatttcctgagcataattcgtttaattgaatcttatgttttccgccgtgcagtatgtgcgattccgacaaattctcttaacaagacgtttgctactttttataaggtcattaataaagaaaaatatctggaaagtattcaggtacattttttgaatctaccttcatatcgtcgtttccccaacgatgatgaatttaaacgggaattaaaagttcgcgatctctataacttccgtagtcgtagctactggttacgacgactggaaaacgataaacgcagagagcgcgtggaagagtttacgattgaacatattatgccgcagaacgaaaatttgtcggctaaatggcgcgaagagctgggaagtgactggcagcgtattcataaagaactgttgcatacgttggggaatctcactttaacgcgctataactcccgttacagtgacagacctttcgcagaaaaacgcgatattgaagacggctttaagcatagcccgctctatttgaatatcggtcttggacagtgcgaaaaatgggatgaagctgccattcacgcccgagccgatcgtctggcggagcttgcggttcaggtctggcaagcgccttctcttcctgaagaggttttagctgtttatcggggacagcctgagaacaaaaccagttacagcctgagtgattatccttttcttgctgatggttcgcatagccgggtgttattcgatcatcttcgcgatgaaattatgcgcctggacgcagggatcacgcaggaagtattgaagctctatattgcgtttaaagcggaaacgaattttgttgatgttgtgccgcaaaaaagccgactgcgattgtcgcttaatatgcagtttcatgaactggtcgatccgaaaggtattgccaaagatgtgacaaatgttgggcgatggggcaatggtgatgtggaaattggtttcagtgacctcgcacaacttccttacattatggggttaattcgtcaggcatttgaaaaacagatggagagcgcgttggtataacgcagcgaaaaatgcccggtagtcctggcgctaccgggtcaatgtatcagg

SEQ ID NO: 247 - DNA  (genomic), 7808 bp; double-stranded, linear
agatgaaaattagcgtgaaatataaattttggtgatgtgaataaagcggctatttagccgctttattggtttttcgagggcaggtaaattagtttaccgccgcgtcagtgagtgcatctgcaaggtgtagttgggtttgctgggcggattggatatgattctttaattcttcacatagtttataaaaaatatgtagtttactcattattttttttgcttctgagctaggaggaatagcaacaggacaacctctgagctgggttttattaatagaagctaaattagtggtttgcttacttgcgttagcaaaatattgtcttgagaatgggctattcatatatgtttctaaccaatatggatcaacatcttgccctatatttcgtcctttgaatacatggttttgatttgctatataccagtcatgacaccatactgtagttctcccgactgtatcccagtcgccgccttctgttatcaataaatctcccttgactacttgatatttttctttttcctcaatagggatttcaatctgtttaatttccgtaagatcaagatatccgcgttggacgtttgcaacacgtaaataaggaacttttaccaaagttctatttgataaatttcttcctttagtgataccactttgaatatcaataatatcttcaaataaacaccactcccacccttccggaagttcaaacggtttttcctcatcgctaattggcggcaacggtttttgtttttttatttttccttctttcaccagttgagctttttcctgcgcaattcgtttgagcagttcagaggctggttcatcattcggatcctgcggcacaagtttgcccattacggccagttgcagaatggtctgttttaacgcatccacgctggcttcggtggtaaatagagtgtcgaaatactcgctaatacgcgcccagttttcagccagttcctcggcggtttggctgtctgtaagcgttcccaacagggtttcaaccagttgttgatgtgcgtccagactggtcagggattgctgttccagttggtcgcagagggacattaattctttgattttgtttgcgatgcgaacttgttccaaggatggaggaactggagttattccagaaaaaaattgtttgtcattgattgctggataggcaacccctgtctgacaattttcaacataacaaacaaataccggagaacgtagataataataaatgaaattagcatccatcgccgtatatggatgaataatagcgaaggcagtactagcgatcggttcaggtagtatttcgttttcaataatagctatatttaacaaatacgggcgaacagtagagtatatgatagtcccttgctgaacaatttttctcgctcgcgatggggcatctttcgctgaaagaatagatagctcttcaataattccatattctttatttattgaaccaacatcaatgtaagtaaaatctttatctggagttttttgtccccagtcatgtccaatttcactaatacgcacccactcccatccctccggcaattcaaacggcttctcttcctcactaatttccggcagtggtttttgctttttaattttaccttgcttcaccagctctgctttttctgccgcaatacgcttcagcagctccgacgccggttcatcgttcgggtcctgcggcaccagtttaccgcgcacagccagttccagaatcagctcacgtaatttcttaatgccatataaatcaatttttccggaactgccgcgcccggcggtggaacgggtttgcaacgccgaggtccaggtttccatatgatcaacgatcagcttttccacactcattagttaacctccttgccagacagcgcagcgccaagaatatcgcgcagttgattacgcagcgtctggatctccgcctgctgttttgcatactgcgctaacagctcggccggatcatggctgacggtttccgcctgatgtgggtttttaatatccagattgaagttacgcgcaatcacgtcatcaatgctgactttccacgcctgctcattctctacgcggctggcaaaaccatcggcctcgttaccccaccagtcgatctccgcctgaaactcttcaaacttcatcggcttagttttgctgtagttttttacgcccgccggatacggatgctcatagaaccaaatctctttggttggctgacctttggtaaagaacaacaggttggttttaatgccggtataggggttaaacacaccattcggtaagcgcacgatggtatgcaggttgcactcttcggtaagtagctttttgattttggttttaacgccttcgccaaatagtgtgccatccggcaataccaccgccgcgcgaccatttttcgccagtacttccacaatcagttgcaggaacaaatccgccgtttcgcgggtttgcatctctgccggaaagttcttctcaataccgtcttcttccgtgccaccaaacggcgggttggtaacaatgacatccagttgctcatcccgggaggaaagcggtttgttcagagtgttgtcgtgacgaatttgcactggcacttcaatgccgtgtagcagcatattggtggtcgccagcaggtgcggaagctgttttttctcaacaccgtggatctgttgttgcagcgtctgatgatcggcgacgctcttcacgtatttgttctttacatgatcaaatgcgcaggcaagaaaaccgcccgtaccgcaggccgggtccataatggattcgccgagtttcggatcaacgcgatccaccataaagcgagtgacggcgcgtggagtatagaattcgcccgcattgcccgcagattgcagatctttaaggatctgttcgtaaatatcaccaaacagatggcgttcgctggcgctggtaaagtcaatttcgttcagcttattgatcacctgacgcagtagcgtaccgtttttcatatagttataggcatcgctgaacgcctgcttcaccacgtagccgcgtgggtttttatcgataggcgcagtgaggtttttcaacgccgggaacagatcatcattaacgaattccagcagggaatcaccggtaatgccctgcgcgttggcggcccaactgcgccataaataacgctgtgggatcggatattgatagttatcctgctccagttccagcgcctcttcctgggcatcgaagattttcaaaaacagcagccaggagagctgaccgagacgctgcgcatcgccatccacaccggcatctttgcgcataatatcttgtaatgatttgattactgagctgatagacatgttgtattccatgaaaaacaaggccttctgcaacatgatggttgcagaaggcgcaaaagagagttgttaagcagagcggggcggtaattggtagatttcgttttccagctcgctgagcgcctgattatacccgttacggtcgccaaatccggttttaataatctccggtaaggtgcccatgctgtcgaatggcttaagtttcagcacctgaatactttcgatctcctgtacgcccgcatcggcgtatttatccagcagattatcgagcacggcttgcgctgcttcagagtattttgtgaagtagttccgcttgcgcacgttctcggcgcgctctttgcgggttaacggcggctgaccatacactacgtggcaaagcatgtcgaacgggtcgagatctttaccgacttcttctgccagtacttcccagatgatcccctgttgctccagctcgtgaatgatcgcttctttgcgatcggcgtcctgccacttgcgggtaaagtcatccagcgaggcatattctttgagcagtgttttgcgggtgtaatctttaaaggattcggtaaccagtttaccgtcggcgtcgtaatactgaacacgctgggcaataacgcccactgctacaccgttgacgtgaaacttgcggattttcttctcgtcttcttccggaagtgggccgacatcatcggtatctttaacctggtatggtggcgcaggcggttcatcaacgcctgttacctgttcgtcgtcatgttcgctgatttcttcgagtttctcttcaaaatcagattctggatcggcgatatcctctggtgtggtatccatgactttttcgggaatgccatcgaaacgctcatcggcaaacagttcggtggcttttttaaagtcgaggatggtaaaccagagtttgccgtaacgttcgtcgatgcgtgtaccacgaccgataatctgcttgaatttggtcatcgactggatgttctggtccagtactaccagtttgcaggttttagcatccacaccggtggtcatcagctctgaagtggtcgcgataaccgggtacggttttttcgggttgatgaagttatccaactgagctttgccaatttcatcatcgccggtgattttcatgacgtatttgtcgttctttttcacctgctccgggttgagattaaccagggcgcggcgcatacgttctgcatgatcgatgtcgttacagaagacgatggttttatccatcggattggtacgcttgaggtagtcggtaatggttctggcaaccagttctgtgcgttcgtcgattaccatcgtgcgatcgaaatctttctggttatagatacgatcgtcgatcacttcgccgtttaagtcagtttgccctttggttgggcgccagccttgcagatcaacatcaatatcaacacggacaactttataaggggcgaggaagccgtcttcgatcccttcttttagtgagtagacgtaaaccggatcgccgaagtaatccgtgctggagacttcatgcgtctcttttggcgtggcggttaagccaatttgggtggcggaactaaaataatcaaggatttctcgccaggcgctgtcttcggatgcgctgccgcgatggcattcgtcgatcacgatcagatcgaagaaatctggtgcgacttgtttaaacgctttttggtcttcctccgggccagttatagcctgatagagcgcgaggtgaatttcataagcgggatcaatggtgcgtccgctgactttggtcattgccgtaccaaatggctggaaatcattatttttggtttggtcgaccagaatattgcgatcggcaaggaacaaaatgcgttttttattttttgatttccacaggcgccagatgatctggaatgcggtataggttttccctgttccggtcgccatgaccagcagaacgcggttttgcccgttggagacggcttcaatggttttgttgattgcctgaagctggtaataacgtggcgatttaccgctgccatcgtcgtaatagtcctgagtaatcaccggaagctgagcttgtgtgtatcctttccagaggcagaatttttgccagagttcagcgggggaggggaagtcatccagcgttatttgcttttcaaggcattcaccttcggctgcggtggcatcgcggaagataaagccatcaccgttggtggcaaaaacaaaaggaacgtccagcaggcgcgcatattcaatgccctgttgcatccctttgccaatttcatgtttgttggcttttgcttcaatcacggctaagggaatgccaggtttgtgatacagcacgatgtcagcagattttaccgttctgcgtgccgcaactttaccacgtacgatgactttaccgtcccggagtttgacctcctgtctgatttgcgttgtgttgtcccagcctgcattgagaatggctggcataacgcatttggtaatgatgtctgcttccgtcaggttacttaggttcagttccgccatggggtattctcgcttttatcaggacgattctgattgtacataaaatcaatagcctggctatgatttagggcggtgtttcaacgtaaagtacgtagcagagatcacattgatatctctgttatatcttgcttgaattaatctgggcatatcagagacagataaacagaagttacaggaaccatatcaactctaacaaaatatataaaaatcttatagttgcgtttctttcgagcaagaaagataatgttattgttgattgtttgattgggtatatgaaatggaagctaaagaatgtaaggtgcaggatatccttactgaaaacaaaaagtttattattccttcttatcagcgtccttacagttggacggtagataatgcagagcaactcattgatgacatttataaaagctctcaatcagaagagaatggatattttattgggagtatgatttgtatcaataaagggcaaaatcagtatgaagttgtagatggacaacaacgtcttacaacgttaagcattattgtctccgagctaaaaaaatcatcccgattcaggggataaaagatgatttgcaaaaaagagttctgcctattgatgtttattctgatgaaacagatgaaccaagactaattgttagaaaaaaagagcatgatctttataaatattatatactgcaggattctaaagattataaacctgaaaagccatcggatactgagttagtattcattagcaacgctgaaacaattagagattatttgttgcggttatctgttgatgagttgaagttgcttgctaaatatattttgcaaaatgtatatatcgtatttgtgcaaacagatgatttcgcatcatcatttagactctttaatgtattaaatagtcgaggtttacctttaagtaatgcagatcttttaaaaaatgcactgtttgaatcagcttctacacataataaaaaatcagagcaaatagaatcagcatggtcgcaaattgaagatatggtcggagtgagacggcttgataaatttcttactcttcataagctttccgagaaaaaagatcgtgacagggtgttacaaaaaggttttgaagcttttattgaaaatctccagcagcaatttgatggagatgctattgctatgtcactgatgttggttaattctgcaaaaaattatactaagattttagagaatgattttgaacacccttcaatacgacgaaaaatagcatcgctaagtaatttaggggtagatgagtggattcctccggttatggcattcatgaatcgaatggctcgtacagaagattttaatttagatgatttttctcaatttattaccgcctttgagaaggtatatatgcatgggtggttaaaaaaacaaattaaaagccaaagagaaatggtttgttattcagctctggtagcaataaataatgatatgccttttgattctgtgataaatcagataaaccaacatgcagataattcaggttttatagctgctctggatgaagatttatatgagcctcgtccgaatcaagtgaacttaataaaagcaattttgcttcgcttagatatggagcaacaagatgagagcgtgattaaaacctatacggggagaatcacaattgagcatattcttcctcaagcattagttaatgaatactggattaatagattccaacctcaagagcatgtctactggctgcataaaataggtaatttaacactcataagtggttccaaaaattctgaagcacaacactatgattttatcaaaaagaaatctatttatgagaaacttaatagtaaaagctcttttgatttaacaaaagatgtttgtaattcttcagaatggggattggctgaactgaaaatgagacatgaaaaaatgaaaacgcaattgaagaagctttggttggtctgacatatctaaagagttccactcgtaataatgttgcggtggaactctcaaaaagttgatctttcccgaac

SEQ ID NO: 248 - DNA  (genomic), 822 bp; double-stranded, linear
tttgagcaaggtttatgaaggttatttatgtgatgatgatcacaaccgaagcgatttttagccctcggttgtgtaactcatttaaaaattatattcatactataaatattaaataacaatatagcaatatggtgtgttatttatttctttaagtaaaacgtgttttttacgagatttagtaagataaaatttctcatctaaatagcaatcgatgagagagtccagcctttccctgtctatcataggggtgatacccaaggtccagaaactgcgtaaatcgagttcggaacgttttatttttgcgcttttttctaagtctgcgatcatatttttaacacaactggtcgcgtctctgttttgttttatttcaagcgcgatatagctatcttgtgcccagccttttttacgtagtaagaaatctgtgcgtagtgtcgggcgctcaggttttttgcgcatatcacaggaaagtgcttgttcacgccaccattcatggtctgttgagcagagcatattagcaaactctacctggaaccacacttcccaaccggtgatattgttttggtcaataatattaagcttttggcaaatatcctcacgttcaaaaaagagatgtaatagcgttgagagatgatcgaagtcacggtttaacatttcagatgtcctttcttaaaattccacactctataaaatatttcgttcaaaatagatacaattcgtgtgaaaaaaataagaaaagaaaatgtatcaataagtggttattgtatttttgaacaaaaattaaaaaaagtgaggtaaaattaaccagtttcaagtcgctaccta

SEQ ID NO: 249 - DNA  (genomic), 53 bp; double-stranded, linear
aatagcaactgatttatagatttactattatttttcatatggatagaaaataa

SEQ ID NO: 250 - DNA  (genomic), 287 bp; double-stranded, linear
tcagccgtcatccaggaagggcatatcagcaactctggtggacaaccataaatttctgccattttgcttttgatgtttgagctaagccgttccgtcttttcgatctgttttagagaattaatcgagatacctaacattttacttacttcagcaagcgataatttatgcctgatacgcacggcggctagccaggaaatacgctggctgaacattaaattgataatctcccgttcctggttttccagatcgatcatatttccttccttggatattttaatcagcgagtt

SEQ ID NO: 251 - DNA  (genomic), 22306 bp; double-stranded, linear
cgtttctgacgttttcgccgcaccggcactggtagccgccgcgctttttgaggactctgcagcggcagcactttttgatgcttcagtagcctttgttgatgccgttcctgcgctggaagacgctgactgagccgacgacgcggcctgtccggctgacgtgctggctgcgcgtgctgagtccgcagcatcagtcgcatgggttgccgcctcacgggctgatgtgctggcatcgctggctgacttcttcgcggctgccgtgttctgtgccaccgcggacgcgttacgcgccacctcttccaccatcagctcaaaacggcgcagtgcctccggacggacatcatcctcagtcatggcaccaagaaaatcattcagcgtaccgggttgagaatcttcatacacggtgatggtcccggcatgtgacggcgggaacccttccaccaacagaataacgctgtactgaccgtactcaacgtccatgctgtaacgaccggcttcatccggattttcagaggccaccgtgttcaccaccaccgtgccgctgttacgtctggctttcagttgaatggtgcagttctctaccggttttcctgtgccgtctttcagtacacctgaaatctttactgccatattcaccccacaaaaaagcccgcctgaaccggcgggctgtcataacactgtgttacctggctaatcagaacttataaccgacacccacgatgaaaccgtcagtgcgccagtcgccactgccggagccttcataagcaatatcaatggccacggattcggtcgggttaaactgcacgccagccccccacgccagagacgtgttgctgtggcgaccgtcatcacttccggtcagcacatcgtgcgttttccccttgttgtcagttacgcgaagataatccccggagaaagtcgacacacggctgtaagccacacccgccatcgcatacgcgctgaaccattcattcacgcgcacagacggccccgccattacgctgaaccagcggttacgaacggaatcttcatgccagcgggtatcgctgtaacgggtaagctggcgattcttgtctcctgcatagctgaatgacgtcaccagccccagcgtatccgtaaactcataacggtatttcacgttaatcccgttcagatcatcactgccgggaacgttggtccgggcatgaagataccccgcgctcagcgtggactgatgttcagatgcccatgcaggcgcaccggatacggccagacaaatggctgcggacaaaatggcggcataaagtttacgcataattacctctcgcttttctgcaataaaaaaggcgtcatttctgacgcccgttctgggttataaaattcagctgatactgatacctgctgtggattttttcatcaccacaaccagcagatcgctgatactggttgttggtgtccagttattcgctcctgatgaagatacggtgaatgtcagtgtcagcgtcccctgtccggcaggcatatctataactgaggaaaatacgccctgagcatccgtcgtggactgattaaaaatctcctggccattgcgggtcactcttaaccggcaggttgaataccagtatgactgttggttattactgttgaaattctcatgcttaccaccgcggaataacactggcggtatcatgacctgccggtcaaatttctgatcatcactgattcttaccgtgatggtgccactggcataagtgctcgtgcgggggaaagacttgctgaccgttttgacaatatcgccttcaatctgattggctgacagtttccccttaatctgacagttctcattaatcgtgacgttgttgagcgtcccggagttcgcattcacactgccactgatatccgcatttttagcagtcagctttccgtccggtgtcagggaaaatgccggtggatttccaccgctggtaatggtgggggccgtcaggcgcttcaggaacacgtcgttcatgaatatctggttgccctgcgccacaaacatcggcgtttcattcccgtttgccgggtcaataaacgcgatacgattggcggcaaccagaaactggctcagcttgccttcctccgtgtcctccatgctgaggccaatacccgcgacataatgtttgccgtctttggtctgctcaattttgacgccccacatggcattccacttatcgttagcatccttccactctttcgaaaactcatccagtctgctggcgttatcctccgtcaggtcaactttttccagtagctctttaccaagatgagattcggttatcttgcctttgaaaaaatccagataaccttccgcatcatcgctcgcccgaccgacggcctccacgaatgccgatttgccaacggtgttcacactgcggatataaaagtaataatcatggcccggtttgatattgatactggcggctatccagtacagcgccgtaccaagataacgcgcgctggtttcaacctgcctgatatccgcaatccgcgtttccgagaaccagaactcaaactgtaccgtcggatcataaaccgcaagatgcggcgtggcggttatctgaaaatagcctggtgtcagctcaatccgaaacngcgctgccggtgcggcaatccggaacgataccgatgccggatctccctgctgtccccacgcatttaccgcccggacagtcagcctgtagttccccagcgccagttgcgtgaagcggtatgtggtttccgtcgtcctggccgtactgaccagccgctcactgccatcgtccgctgccacggtcaggcgaagcaggaagctcacccccttcaccaccttcggcgtgtcccagcgcgccagcacctgatattccccgctgtctgcggtgacttcggcagtcaggtgctgcaccgcgggcggcgtgacgccattcaccgtgccgctcaggtcgccgtcaaagtgcgccccgttatccacgatggcttctttttcgggtacatgctgcacggcggtgatggcatacgtgccgtcgtcgttctcacggatactcacgcagcggaacaggcgctggcgcaacgtcggcaacttcagcccccatacgctgtatccggcaacgccgtcaggaacacggctcacttttaccttcacgccgtcggtgacggactggacctccacgctgaccggattgccacttccgtcaaccaggcttatcagcgtggtaccggaggatggcagcgtgatttcacggtcgagcgtcagcgtccgggtctggctgttcaccgccagcacacgcccaccgatgctgatccccgcatagtcatcatcacagatttcaatgacatcgcccggtacatggcgaagcccttctgcgcccacgctgaaatccacggtctgcgtctccagcagctccgttttaatcagccacagcccggcgcggtgtgcctgcccccggctggtacagccaaaggcatccatcttcgtgacgttacgaccgtaacggagaatggcctgcgtgtcctccacaagctctgtcgccgtctcccagccgttatccgggtcaatccagttcacctcaacggcattatggcggtccttgagggcgctgaagctgtagcggaacgacgcgccatcatccggcatcaccacattactgcggttataggtccacaccttatccgacggtcggtcctgcacgaacgtcagcgtctgcccgttccataccggcatacagcgcatcgccgagcagaaatcgctgagaacatcccacgccttacgctgtgtggtcaggtaggcattacaggtgatgcgcggctccgtgccgccaaagccgtccggcactgactggtcgcagtactggccgatgacatacagcgcccatttatccacatccgccgcaccaagacgtttccccatgccgtagcgcggatgggtcagcatatcccacagacaccaggccatgttgttgctgtatgccggtttaaacgttccgtcccagataccgctgtattgccgcgtctgcgggttataattcgacggcacctgcagaatacgcccgcgcagatgataattacggctcacttctggctgccgaactgctccgagtccacctgcacgccgaccagtgccgtgttcgggtagcactgtttcacatcgataatttcggtgtatgacgaccagagcgttttgttctgcagctggtctgtggtgctgtccggcgtcatcctgcgcatccggatattaaacgggcgcggcggcaggttatccaccaccaccgaggccagatactgtgaagtggttttacccttaatggtgatgtctttttccgtcacccagccaccgttacgttgtatctgaaccagcaggcggacttccgatggattcctgtccccctttgaggtggtttccaccagtgcctgcacgccgaaagtaaaacgcagacggtcaatgtttgccgacgtgatggtccgggtgatcggcgtgtcatatttcacttctgtaccgagcaccgtctcggagccggaggattcaaatccctccggcggtgtctgctcctgctcaccggcccggaacaccaccgtgacgccggatatattggtattcccctcactgtccagcaccggcgtactgttcagcagcacgctttttaatccatccaccggaccttcaaccggcccttcgctgatggcatcgatcacactcagcagctgcgtggacttcaggttgtccttcgcttcgcgcggggtatgccccttactgctgcctttacccattcgtcatgctccataaacgataaaaccgcccggaggcggtttcacataaaacattttgcatcagcgaccaatcaccacaacctgaccaccgtccccttcgtctgccgtgctgatctcttgagaaaccacgcgtgaccccacgcgcatttcaccgtacagaaccggcagaacattgccctgggcaaccatgttatccagtgaggagaaataggtgttctgtttgccgttatccgttgtctgtgtacggggagttctggctttcggtgccagcatctgcgccacaccaccgagcaccatactggcaccgagagaaaacaggatgccggtcataccaccggccccaatggctgccccccatgctgcaagggtggctccggcggtaaagaatgatccggcaatggcggcagcccccaggacaatctggaatacgccacctgacttggccccggcgactctgggaacaatatgaatcacagcgccatcaggcagagtctcatgtaactgcgccgttaacccggacgtgctgacgtcccgcccggtaatccgtacctgataccagccgtcgctcagcttctgacgaaacaccgggagctgtgtggccagtgcgcggatggcttcagcccccgttttcacacgaaggtcgatgcggcggccaaatcgttgcaaatccccgtaaaggcagatgcgcgccatgcccggtgacgccagagggagtgtgtgcgtcgctgccatttgtcggtatacctctctcgtttgctcagttgttcaggaatatggtgcagcagctcgccatcaccacagtaaatggcggcatgattcggcaccgatgaaccaaaacagcacagcagcacatcgcccggttgtgctgatgacaacggcacctgatacagccctgtggcctccagattatccagatagagattctgaccgtgacgccaccagtcatcctcgcgatgaaaatccggcatctcaatccccgccagatgataagcatcccggaacagcgtgtaacagtccgtcaccccgtgctcaaagcgccgcccggtgagatgcggcacacagcggaacttatgaatcgtcccccggcagaccagccaccacggcaaatcactctgcacctgcagccgccggtcggcctcactcagccagggcagaccaccggggtggctgtggaccagcgccacaatctcaccctgcatttctgcctgcagccagtcttccggcgacatacggaaatacgcctccggctcaccggagatattcacgcaggggaaatatctttccccctccggcgtgcttaccacgaagccgcacgactccgctggcgcacatcgccgggcgtgcgccagaatcgctgattctgtctgtgtcatgggatttactgcgaaagtttgttaatggaaaggaagccgccaaagttgccgacgttattgcggaacttacaaccgctcaggcatttgctgcatttatccttcgtgatatcggacgttggctggtcatattcatccgcgaccgccggaccgtgataaccgcactcatcgccgcgataggtccaggtgcaggtgttggccagcatgatacgtcccggaaaaacagcgccgtccgtttccgtcggcgtggacagtacaaaagaggcactcaccgcgctcagttcgctgcactgctcaatgcgccagcggctgatcacctcctgctccggatcggcgtcactgtttccgttgacgaagttcaccgcatccagaaaacgggcgtaaaccttacgccggaccaccgttccgccgaccagactctgcagatcttccgccatcccggtgaccataccgtacaggttagaaaccgtcagcgtggggcgcgtactggtgcctttgccattcagttcaaaaccactcccctgaatgggatacggctgatactgtcgcccctgccaggtgaccggctcacctttttcgttctgctcattacagaaaaaataacgttctccaccgacctctgtcagatcgatttcccagagcaccacgctggccgactgctccgcacgggtgcattcattcagtgtttcctgccggatatcctgcatcagttcaccacctgttcaaactctgcgctgaactcaacacgcagcatactgacccgcgacgaccattttgcgcaggtcacctttatctgccgccactcataaggcggcgtccacagaaaggccttccagcccccgtgctcagccagaaacgactcaagcgccgtggcctcccaacggggaacagaaagcgtcacgctgtacgttttcaggtcggcattcagcccggcaggcgctcgctgggaatagccatcaccaaagcgcacctttcttacggaaggggccgaagccacatccataccgggtttcactttccagcggaaggttttcatcgtccacctccggagaacagaccaccatcgcgcatctgcccggtcacaacatccattgccgccttacgggctacgtcataaaccgccttcagtgcctgtggccctatctgaccgttcgtgccgtcgttgttaatcaccacatggttattctgctcaaacgtcccggacgcctgcgaccggctgtccgccatgctgcccggtgtaccgacataaccgccggtggcatagccgcgcatcagccggtaaagatttcctacgccaatccggctggttgcctccttcgtgaagacaaattcaccacggtgaacaatccccgctggctcatatttgccgccggttcccgtaaaccctccggccgcaaaatggaatttcgccgcagctgcctgaatggctgtaccgcctgacgctgatgcgccgccgccaatggcgctgcctatacttccgacaatccccaccattgcctgcttaagcagaatttctgtcatcatggacagcacggaacgggtgaagctgcgccagttctgttcactgccggtcagcatcgccgccatattctgtgcaataccatcaaaggtctgcgtggcagcacttttaacctgcgacatactgtccgtggcgctctcttcccactcactccagcctgacctgaggcctgccatccagctcccgcgaagctggtcttcagctgcccaggtctttttctgctctgacatgacgttattcagcgccagaggattatcgccatactgttccttcaggcgctgttccgtggcttcccgcgctgcctgccggtcagtcagcccccggttttttgcatcaatggcggcccgttttgcccgttgttgctgtgcgaatttatccgcctgctgtgccagcgcgttcaggtgctcctgataggtgaccttgtcgccaagtacagccagctggcgtttgtactccagcgtctcgtctttatgcgccagcagggatttctcctgtgcggacagctggcgacgttgtgccgcctcctccagtaccgcgaactgactttctgccttccacaaatcccggcgctgctggctgattttctcattcgctccggcatgcttctccagcatccggagttctgcctgaagcgtcagcagggcagcatgagcactgtcttcctgacgatcgcccgcagacaccttcacgccggactgtttcggctttttcagcgtcgcttcatagtcctttttcgccgccgccatcagcgtgttgtaatctgcctgcaggattttcccgtctttcagtgccttattcagttcttcctgacgggcggtatatttctccagcggcgtctgcaggcgttcgtaagccttctgcgcctcttcggtatatttcagccgtgacgcttcggtatcgctctgttgctgcgcatttttgtcctgttgactctgctgctcagccttctttcgggcggcttcaagcgcaagacgggccttttcacgatcatcccagtaacgcgcccgcgcttcatcgttaacaaaataatcatccttgcgcagattccagatatcgtccgctttcttaaacgcggcctctgccttaatcagcatctcctgcgcggtatcaggacgaccaatatccagcaccgcatcccacatggatttgaatgcccgtgctgtcctgtctgcccaggtttccagcgtgcccatgttctctttcaggcggcgggtctggtcatcaaaccctttcgtcgcggcctcgttcgccgcctgcaatgccccggcttcttcgccggaacgctgcaactgagcaacatacgcaatctgctccgccgtcacgttatggaactggcgcgccatcgctgtcagccccgacgtcgggtcagtggtcagcttcccgaaggcttcagcgaccttgtccacctccacgcctgatgcagaggagaaacgcgccacactctggctgatggacgcaatctgagcctcaccgcttacccccgccttaaccagtgcgctgagtgactcgctggtctggttaaacgtcagccctgccgcctgcccggctctggacaggaccagcatacgatctgccgtcagcccggcctgattgccggaaaggaccagcgttttgttgaaatcggacagggttgagttgccctgataccaggcatacgccagcgcaccggtcgccaccgccagcgaggtggcccccaccatcggcagggtgatcgcaccggcaagcccccggaacatggggatcatcccgccgaaggagtccttcacctgccccccctgttgcagcaggatcagccacggactttgcccacctgcaagctgcgtggccacgtcagtgaactgcgcaggcagcatacgcatggcggctttatactgcccgacggaaattcccgctttctgtgcagccagcgcctgccggctcatcgactgttcaacgactgccgctgtttttttcgcatcactttccgtaccggaaaaatgacgcctgactctggccatctgctcgtcaaatctggccgcatccagacttaaatcaacgaccagatcgcctaccggttcagccataccggactcctcctgcgatcccttctgatactgtcatcagcattacgtcatcctccgtcatgtccgccacatccggggaagcggggataacttcattcccgtccgggccaaaacgaacgcctccagcaagccctgccgctttctgcatcagcacatcatcttcaggctcttcgtcagcctcacgccggttcagcagactgaaatccagcggatgcatatccggatcgctgaaaaacaggctgagcacggtgtacgtcagcccggaaaagtgcatatccagcagaacatcatgaaaataatgggtactgtaaaagcggtgccagtcggcatactccgtggatgacatcccggcaagcatggcacgccagtcgggtcgccccatctcgcgcgccagtttcagggcaaaactcagctcaccgtcgaacactttcccgcagaaacaggctctgcaggcccggcgtcctctgcctgttcaggggcatcattcaccacaaactcatacataccggacagccggtacaccacgttttcagcatgagaaattgcctccgcgggccaggtggtaagcacttcctgctcaatctgtttaacggcttcattcatggacggcatctgcgtcttcttcggatggttatgccacagggacatcgccaccacaaaagcgccggttctgatggcgtcttccacagtaaacttccggttgctgtctgactccgcctgttctgcctgccgtttcatcagggcgagatgctcaatacgctgcagggctgacagttcagaaagcgtgacggtcacgccgttatgttcaaatgattcggttttcaggaacatcgctgattctccggattaactggcggtgacgttgatttctgcaaccgcagcaaactcaccattaccggatacgaccggaatgttgaccttgcctgcagcaacacctttcacggtgatggtcataccactgaccgacacggtggcttttgttttatccgcagacaccgcacggaagttcttgtcggttgcgccttccggctggaatgccacggtcagcgtcgtgctctgccctttcaccaccgaggtgctggcaggcgtcacggtcatgccggttgccgctgttaccgtgctgcgatcttctgccatcgacggacgtcccacgttggtgactttcaccgtgcgggtgatcacttcnttcgccgtcaccgccttaccgatactgctgacccagccgcggaacacatcgaccgtgccgttcgggaagcggattttataggcacgggtatcaccttcattaaaccacgccagcagcgcctgctgcccctgctctccgggcatccacgccagcgtgaagctggtatctccagcggatttctgcccctgtccggtcgcggcccagtccgcatcttcatcatcgagataactgtcgtcataggactcagcggtcagttcgccgggcgtcaggtctttaacctttgccagacgcgaccagtcattgtctgaaagcgggtttgcatatgggtcgccgttcccgttataaacccacagtgtggtcccggcccctttcaccggtgccagaggatttggtgttggcatatcgtcctcacatttcataggtaatgacataagtcagatcggctgaactccacaggcccgcatcatcgtcgcgccggtagtcatagccactggccaccatactggtgatcaaatctgatagtgccgggatatcgctcatcaccggataaatccgggactccatccacgcatccagctctgaatccggcacctgagcaggcaggaaaacttcgatatgcagctccgctgccaggtatcgctgtccagctcttcgcccgtgtattcagcgccggtgagataaacggcaactgcggaaaatccgctcatcaaaaacagcggggcgaccatcaaaaaacgtcgccccggtgtcatgcttctccagtgcatccagtacggctgcacggagttcagtatgtttcatcgctttattaccattctcagttgatgctgcagcgcatagcccagctctttcggaagacgttcacgccgtatccgctcaatattctgtttaaacgccgtggtcagcggcaccgccatcgggattttcaccacatcaatggggtaacggtttttcccggccacacgctgcatgacatgccaccggccatttttcagttgctgaataaacgcgccgggaatacgacggtttcccaccacaagcacgctgccgccacctttcagggatgaacgctgcccctttttacgacgcctgcgtcgggacaggacaacccgcgcgttacccagcttgattacgggcaaatccccccggttaaccttgattctggcctgcggatttttaaccgtggcccttttcagcctggccctttcctttaccagtttccggcgtactcttgtctcacgggcaacctgtgacgccgactgcgatatcgcggatgaagcaacgcggttaatggccattgctgacgcaccaggcaccgccgttttgctgatacgactgaggttttcaacggcctgctcaagaccttttatggccatacatccccccttcagcgacgacggttaacggcaggcggtacgccccgcccaagccagagatgacagcttccgccatcatccgtcgaaatccggtctatccagaagttttcctcaccgatggtcagcgtgtctccacgccgcagttgccgcacatcatcagtccggacaaacagggacgggctggagccttcaacacgcacgccctgtccggcatagctgatattttcagggtcatcaaaaacaccacgtattactgcgccggactgctcaccggatgtcatggtggctgacgttcccatgtacccgcgtatcgtttcatcggcgcgggcaatggcagcatcgaacaggttatcgaaatcagccacagcgcctcccgttattgcattctggccaggccgcgctctgtcatttcggctgccacaccggcagagacacgaaacgccgttcccggcagcacaaatgccacaggttcatcccgcgtgacgtgaagtgcatcagtatgcagcttcaccagtgccacgaccgtgaccagttcagacgtatccagaatcacggtatccggctgcgctgatcccacctcattttcatgtccggtcagcacattttcccggctgagaggggtgtcctgaccggcagtttcatccgtgtcatcaagctcctcttccagctctgccacacggagcgccagttcttctttcgtccccgtcaggctgacatcacggttcagttgttcacccagcgagcggagacgggcaatcagttcatctttcgtcatggactcctccacagaaaaacaatggccccgaagggccatgattacgccagttgtacggacacgaactcatcagggtcagccaacagcatcagcggtgctgactgaatcatggtgaactcacgcgccggatcgccggtggtcacccaatttttcgggtaacgggcagaggcgttaatgccttcgcgctgtgcgtccgcatcctgaatgcagccataggtgcgcagaccgcgtgcctgagtgttccccagcaccatcgtgttgtccggcaggaagttctttttgacgccgttttccacgtactgtccggaatacacgacgatggccacatcgccatacattcccttataagacaccgctttgcccaggtcttttaccgctgtctccagttcggaatgagagccgcgacgggtatccagcttctccctgacggctttgaaggaacggaacagcgcccagcctttcgggtcaaacacgatgatattcaccacgccgctggcgttcagcgcgtaggcttcgatatcgtcggtcgggtcatacgtggacttgtcacgcttgctccactccgtgccgccggactgcgtgatgttgttcgccgcactgcggcccatatccacctcaaccggatcgaaggcttcaccggtcatggtgtatttgcccttgagcacggcagaaactgcctgcatctcttcgacctgagcaatggccagctcttcgtcacgcatgttctgcatgatgatgcgacggcggcggtaagccgggtccgccagattctgcggatcttcatccggcaggcgacgcagggtcatctgcggattcacttcatgcttcggcttgacatatcccggcgtaaattcagaggtggagccgccacgggaacggataacctcaccagaaacaatcggcgaaacgtacagcgccatgtttaccagtcccggaatttgtgagagatagactttctccgtggtgaagggatagctctcacggaaaaagagacgcagaaacagcggatcaaacttaaatttctgctcatttgccgccagcagttgggcggttgtgtacatcgacataaaaaaatcccgtaaaaaaagccgcacaggcggcctttagtgatgaagggtcaggttaaacgatgctgattgccgttccggcaaacgcggtccgttttttcgtctcgtcgctggcagcctccggccagagcacatcctcataacggaacgtgccggacttgtagaacgtcagcgtggtgctggtctggtcagcagcaaccgcaagaatgccaacggcagcaccgtcggtggtgccatcccacgcaaccagcttacggctggaggtgtccagcatcagcggggtcattgcaggcgctttcgcactcaatccgccgggcgcggttgcggtatgagccgggtcactgttgcccagcggctggtaatgggtaaaggtttctttgctcgtcataaacatcccttacactggtgtgttcagcaaatcgttaacggcatcagatgccgggttacctgcagccagcggtgccggtgccccctgcatcagacgatccagcgcagtatcactgcgcgcctgtgcactctgtggtgctgcggccagaatgcggcgggccgtttccacggtcataccgggggtttctgccagcacgcgggcctgttcttcgcgtccgtgagcctcctcacagttgaggatccccataatgcggctgttttctgccgcaaccgcagcggtgatctgcgcgttcacgtccggctgcgccgcgctggcgttttcgccctccgtcgctggcaccacgccagtaacgtcagcctgcgaagcagtggctgaaacagttgttgattgagtctctttggtcattcgccctcctgagagacgggatttacgtgcatccagtgcatcacgcataacggtgatcgcatcggtgctgttgacaagttcatcagccagtccggcatcaatggcctcctgaccgctgtacactgcagcctcggtatccagcacagcctgcacggacaaggcccggtatatgccgacactttctgcgcaaacatccggcgggttgcatccatccgggactgcagtgtttcccggacatcacccggtagatggctgtaggggttgccatccaccttatggctgccgctgtaaatcagcgtgatttccacgccctgtttctccagggcagcaccgtaattactgtgagccatcatgacgccgatggagcctgtccgggcggtctgcgtgaccagacgccgggaggcggcgctggcaagcagctgacctgcactgcagttcatgtcgttggccagcgcccataccggttttatgtctcgcacacgggcgatgatgtcagcacagtcaaatgctcccgccaccatcccgcccggtgtgtccatatcgagcagaatgccgtccaccatcggatcgctggcagcctgttgcagacgggcgataatgccgttgtaaccggtcattcccgaatacggctgcagcgcccgcgtccggctgaccagcgtaccggacaccggcagcacggcgatgccgttcatgacctgataactccgggcctgtcgtggtccgtcatcatcaccggataacgccagcgccgcgggtgcctctccggcagtcaggctgtcgccggatactgcatccgtcaggcggctgatcccaagctggcctgcaagcgcacaaaagaaaacccgcgcataggcgggttcaagcatcagcggctcattaaaagccatgctggcaatatgcgggagattacgcagctctgctgtcactcttctcctcctctgttgattgtcgcagcccggattcaaatgccgcagccgcccaggcgggcggtttaagaccagctgcgcggcgctccatcgtttcacggacctgctgggcaaaaatttcctgatagtcgtcaccgcgtttcgcgcactctttctcgtaggtgctcagtccggcttctatcagcatcaccgcttcctgaacttctttcagaccatcgatggccatacgaccggagcctatccagtcgcagttcccccaggcactgcgggcttcctgaaagctgaagcgcgcttttgaaggtaacgtcaccacgcggcgaacgatggcctcttccagccagcacagaaacatctggctcgcctgacgggatgcgacgaattttcgccgccccataaagtacgcccacgactcgttcgcactggcccgtgccgtggagtagctcatctgggcgtaattccgggaaagctgctcatacgagacacccagcccggcagcgatataccgcagcagtgactgctcaaacacggagtagccgttatccgtgtcctgagccgtctgcaggttcagtgagtcccccggcatcaggtgcggcacttttgcgcctcccagacggaccggtgctgcggcgtaatacgcggcaatttcaccaatccagccggtcagcctttcccgctgctcctgactgttcgcgcccagaataaaatccatcgctgactgcgtatccagctcactctcaatggtggcggcatacatcgccttcacaatggcgctctgcagctgcgtgttctgcagcgtgtcgagcatcttcatctgctccatcacgctgtaaaacacatttgcaccgcgggtctgcccgtcctccacgggttcaaagacgtgaatgaacgaagcacgaccgccgggtaactcgcggggtatccatgtccatttctgcggcatccagccaggatacccgtcctcgctgacgtaatatcccagcgccgcaccgctgtcattaatctgcacaccggcacggcagttccggctgtcgctggtattgttcgggttgctgatgcgcttcgggctgaccatccggaactgtgtccggaacagtcgcgagggacgggtatcccaggtggcctgaacgaacagttcaccgttaaaggcgtgcatggccacaccttcccgaatcatcatggtaaacgtgcgttttcgctcaacgtcaatgcagcaacagtcatcttcggcaaactctttccatgccgcttcaacctcgcgggaaaaggcacgggcttcttcctccccgatgcccagatagcgccagcttgggcgatgactgagccggaaaaaagacccgacgatatgatcctgatgcaactggatggcgttggcggcatagccgttattgcgtaccagatcgtctgcgcgggcattgccacgggtaaagttgggcagcagggctgcatccacactttcacccggtgggttccacgcccgcaactgcccaccaaatccgctgccaccgccgtgataaccggcatattcacgcagcgatgtcatgccgtccggccccagaagggtgggaatggtggacattttcatacataaaatcctgctggtcccctgcgtcgctgtgtcatgccggtctgcacttccagctcagcaatgtattttttcaggtcagacacggaagtggtcgtaaactccactcgccgtccgtctttctgtaccgttgccacccgttttcctgtcatcaggtcatgcagtgccgcacgggcagcggcaagttcttcctgtcgcgtcattcatcctctccggataangcacgggcgtattctgccagtgttttcttgttggttgctgcaccatcctcttcctgcaggctcgccagcagtgcactgagatccagctgccagcgggaaatactgatgcgcagcgccgccagcgcataaacgaagcagtcgagcgcctcattgcgtcgctttttgctgtcccacagtatttttttcctgccatccacccatttttcgacctgctcttcagcagtcagttgctgcgcttcggtaagatcaaaaatatccgggttattcgggaagtgaacggcaccgggaagcggttcatccccttccggcgtcagtgtgaagcggttataaatctgctctttcgcggtatccgtaccgatttcggtaaggtaaaccccgtttttgtttcgcttacgtggcatgctggccaccggctttccgtagacggatgcccctttaatggggatcacccggaacagcccatgttttttcgagcgttcatacacaatggtcgggtcaatcccgccagtatcccagcagatacgggataccgacatttctgcaccattccggcgggtataggttttattgatggcctcatccacacgcagcagcgtctgttcatcgtcgtggcggcccataataatctgccggtcaatcagccagctttcctcacccggcccccatccccatacgcgcatttcgtagcggtccagctgggagtcgataccggcggtcaggtaagccacacgatcaggaacggacgctgaataatgctctttccgctctgccatcacttcagcatccggacgttcgccgattttcgcttcccacgtctcaccgagcgtggtgttcacgaaggttttacgttttcccgtatcccctttcgtcttcatccagtctttgacaatctgnacccaggtggtgaacgggctgtacgccgtccagatgtgaaaggtcacactgtcaggcggttcaatctcttcaccggatgacgaaaaccagagaatgccatcacgggtccagatcccggtcttttcgcagatataacgggcatcagtaaagtccagctcctgctgncggatgacgcaggcattatgctcgcagagataaaacacgctggagggntcatccggcgtccatttgaggccaaacggcgtctctttgtcgccaaatttaaggtactgctcctccccgcagtgcgggcaggcaacatgaaaacgcataaaatgcggggattcactggctgcacgctcaatctggcaggtgcctctcactttgggcgtggagccacggatggactttggccagaccgagccttcaatacgcttgtcacccaggaacgtcggagagccttcctgttcaatatcctcatcaaaggcagcaagttcatcataacccgccacatcaaccgacttttcacggtagttttttgccgctttaccgcccaggcaccagaagccacgaccattggtgaaacgcttcatagtgagcgtgttatcccggtgctttttgccataccacggggccagagacagcagcgacggaatatcgcggatggtaggctcgacgtgggttttcataaagttctcggcatcaccatccntcggcaaccagataagggtgttacgctgcttatgctctatgaagtaggcataaacacccagcagcatttttgaataaccaacacgggcagacttcaccacattcacntcgcggatgtagtcgctgcccatcgcattcatgatagcccgctgaaagggtagtgtttcccagcgcccttcctggtatgcggattctttcgggagatagtaactggcatccgcccattcaacggcagtctgtggctccggcctgaacagggctcgcagcccggcgcgtacatcacgccgcagaatatcaatctgactgttcgatatattcactcagcaaccccggtatcagttcatccagcgcggctgctttgttcatggctttgataatatcccgtttcaggaaatcaacatgtcggttttccagttccggaaaacgccgctgtactgagagagggatcccgtcaagaatactggcaatttcacctgcgatccgtgacagcacgaaagtacagaatgcggtttccaccacttctgcggagtctctggcattcttcagctcctgggcgtcagcctgcgcacgcgtaagtcgatggcattcgtactcaatagtcccaggctggagatctgcctcgctggcagccctgtaatcctcaacctctttacggagtttttcattttcgatatcagcttccctctgcgcataccactgaattgccgtggcggtatcaaatacagattcaacgcccttaccacctccggagacgcaagggagcccctgagactgccagcgttcaatcgttcgcggatccacgttgaaaatttcggcaagtttctttttattaaccttcatgaaacagtctcacaacaaatacagggtccgacatgaaagtgcccgaaaatgactttttcaggcgttttcatgtcggacctttacggattcgatattagaaaaaacaaatagttatgttcgagaagtaccgacatgattttccccggaaaattttcataaatagcgaaaacccgcgaggtcgccgccccgtaaccggtcggatcgccggaaaggacccgcaaaatgataataattatcatctacatgtcacaacgtgcatctacgccatcaaaccacgtcaaataatcaattatgacgcaggtatcgtattaattgatctgcatcaaattaacgtanaagcaacttcagataatacaaatcagcaacactgaatatggggcaacattatgtcttcnaagaacagaacccgcagaacaacaacccgcaacatccgatttccaaacgagatgattgaacaaatcaacatcgctcttgatcggaaaggttcaggaaatttttcagcgtgggttattgaagcctgcagaagaagattaattaatgaaaaatattctcaatttgtacccaacaaagacaaacacgaccagagaacctgttcagacaggtttacttaaacgacttatatatgacacaaaaagcgaccactaaagtcgctttttcttatggtaacaggcaataacgctctcagatattttttagcatttttttgaccgcgcgtttccggacgtattctgttctcctgtccctttatatcgtcggaatacccgccgctcttcaaatcccattcccaactcagaatgtagtctgttgaccgcttgttttatttcggtcaggttcaccggtgaaaccggagtccggcgcgccttacgcaaacactctgctcgtttctgtgccgccacttttcttttctggtcatcacttagctgtaccatcacttttgcccatcgttcagctgctctccggtacagtccttttttctccagacattctgccaggtgatcatgtagcataagtaacctccgtttatctacagactgccatcctgaatttaccgtccttaataagacaacaataaaaaactaattatataaaaacaataaaaataatatacaaaaaaactaaacaacaaagaaaagcaaatcatatctggcattttaattgaaagagcaattaccgaacaaaagacgctgactatatactcaaaaccaaacaacaattctgccaatcanggtatcatggcaacacacggaattaccatgtttttgccttctctgcccatacaatacgggcatatacttcatacnctattgtaatatttctatccatgtgccccactccatttacctgtaaataatattcaaaatatttatcacagaaattgtttttggccatgaactgagcacactataaagtncggaactgaatttttgttaaattaccttaacgttaccagtaacaccttcgtaacaaaacatcacggtatacactgggtacggatatattcctgtgctccttccagttgcttctgcattgccatcagccgttctctgaggatgaaataatcccgttcagcggcttctgccagtcggggaccggttgcattatccacgccggaagtgatgggggctttacgcaaggagcctggacagttggcgttgatgcgcaggcgcttacgaccagcggcaacatcagcacgcagagtttcattttcagctctcgcatcagctaattccctcgagtatctggcatcaagtgcagcaacatcacgctggcgctgctgcatatcagtaatggttgcatttgccagctccagctcactgacttttttatcgcgctgctctttgtaggttatggcgtttcgcggtnatgattcanccccngactaagcgcaccacagaccaccggcagaataacggtgaacgcggaaagcattcggtttatgctcaccccaccagtgcctgccgaagtcaacgccatccaggttatggaaagaaaaagaacaaccagcattagtgaaaatgaaataccgacgattacacaaaggcccttcgccagcattatgagtttgtctgacatctttaccccttaatagcagtaattaaccgggcaaccacccataaaaacggaatcagccagaccagcaaaaatttccagtccgtttttatcatcttcatgctgcggtagctctccatgcagcaagcagaccagcaatccactgaacaccttttggggtgaatttacgtaaagcggct

SEQ ID NO: 252 - DNA  (genomic), 12848 bp; double-stranded, linear
tctttttcttcccctttcagtctggacagggccagctcacgctctgtttttgtcagggcactctgctgtttatcatccagagtggcctgtggcagccgtaacggcacattcaccagtccctgccgctgctgaagcagttcattacccagccccagcagacggttgaattccgtatgctgaccgttcataaccagcatggactggtacaccttattctgctctgccgcctgctgacgaattaacgccacacaacggtcttccagcccggcaagcacatcctgaatggactgcgctttttcctgcagggatttcacccgactggcctgttcatcaatcagccggttctgctctgtcagcgccgcccgtgttcgtccttcattatctgaggcttcaggcaaagacattgacggcgttttatgcgcgatttcatctatcgtcagtgcatactggcgcgcagactccctggcctgctcctgattctggtacagcgtgtaccatgctgcagcccccagcatcaccagtccgggtacgccaccaaccagccccagcgcaccgctcatcagacgtgagcccaccgccgttgtactgttcagcgcattctgggcggcgcttctggcagcaatatttctgttcaggcgttcctgtgtggccgccanacgggcctctgcagnaatctgcatctccgtcccgcgggctgccgccacggcctgctgancacggtacacggctgcccttgcccgcnccgtggcaatctgcgttcccctgaactgtgcttccgccagtgcaacttcattacgtgcagccgtcnnaagtcctgccgtggcagacatcgctccggaggccatattgccaaagtaccgggcaaccccgacggcaaccagcgcgcccacggctgttgccacattatcaatctgtccggcaacaccgttcagcatgccggagagcgtttttgtcaccccgctggcctcattcgcaccacccacccaggccataaaggcgttttccacctttgtgatcccgtcagagaccgtttccggcatggccgcgtattcatcacgcaatacctccagctggctgattaacgcaggaacgactttatccgccgtcagttgaccatcgtccgccatcgccttcagatctttacgggccacgcccatacccgcagccagtgcacgtacgatccggtcaccactttcattgaccgaattaaattcctcaccgcgcaacacaccctgtgccagcgcctggctgaactgggtgatcaccgaacccgcctcagccgtactggcaccggagattttcagccccgtggaaatggcctccgtcaccttcagcacatcatcagcactgtaaccatattcacgcattgaggctgccgagcgggcaaacagggccgcattatccgaaaaagcggtacctgtccgctgactgatatccatcagcactttctgtgatgacgaaaattcatcagatgactgcgacgcctgtttcagacgggcattcacggaactccactcatcagccagtgaaatcaggtgtccggtggcaaaggcaccggcaaatgcgccagccattccgacagcagaaccgcgaatttccgtcaactggctgttcagttctgccagggcacgtcgctgatcccgggctgccgcagcggcctgacgcccgccattctgcagggtccggtaatattcactgcccatacgggacgcccgctggatctccgactggaatgactgcgaatttgccgaaattttgataatcagttcacgtaacgtcgccattcacctttctccgggcaaaaaaaacctgccacagcaggttttcatcattatttatgacattgctgcaaggctcagcgcgtcttccagcgccgcaaacggatccacctccggcttatcctcatcctcgccccagcagagcatggcgtccttcagtgcaacattcatcccctgtgccccgaaaaccgctttcacgatctgtgcattacggatatccccgcgctcatcacccagcggggataccctgtcgaactccatccacatcatcgcctcgctcgcactcaggctgtggcgcagttcggataaggtgcgccccagacggagcgcaagtcgcatcagaaagcgaatttccgggcgggctacttttttctggccgactctgcatcagcgatcagttccagtgcctgacgcagcaaccgggcatgtaccggaccatagacggccagcacctgctcacggtcgtccggagcgaacacccgctgcagatccgtatcacacaggacatcgcagaacagcgtcacatccgcttccaggttacggcgggttttcgccaccaccgacagggtatcgtcatcctctccatcaccattgagcacttcctgccacagataccaggcctctgccgaaggctcccgcagcaccacgctgacatttctccattccggcaccttcaccgttttatgacggaaccccgacagtctggccagcgccagtgttttcagatcttttgccataagccttatccgcccgcaccattaaccgttaccgtacacgcatcagaggtaatgctctgcggctgttctgcagaatccattaccatgcaggtataagcccccttatcacctgactgcgcattggctttactgaaagtgtcagtagtctgtccctcgaccggctgaccatccttcttccaggcgtatttataaggcggcgttcccccgttgacactgactgacattgtcagcagcgcaccggtattcacggtaagtgtcttctccggatttttcacaaacgccagcggtaccacataggacaccggtttacccttcaggcgaagtgaaaacgttgcagccaccacgccgttggtaccggatgaccaggtgtgctgacgcacttccgccaggaacttaaagcccttaccggacggaaactgcaccttaaacgcatacaccgtgtcattgtcataggcatcacgcagggcgttctgggcctgattcagataaaaattacccgacatggaaatctcggacgacgcccccagaccgttgatgttctcctgctctgtggagcagagcgtggtcacatcaatatcctgtttctgaccggcggtgaactggacttccttgatggtgcagtccaggcgcagatattccgccttatccatagtttcagcagtcgccggggcagatgaaatcatcacctgcgtcagctgtgagcgttcatacaaagcagacattctgcctcctgataataaaaaaacccgcacgcggcggggtatgggttttgtagaaaaaaaagaaaaagtcacaccgtgacctgaaactccagggttgcacggtaacagcggttttccggaatatagtcctgcatttcactgacggatcccggggccagcagcattatggcttcacgggcgtcctgacgtatctgacgcgcctgcgtcacagtcccggcataaacgtctatctgcaccgacactgaggactccgcctgcccgcccatcacgtccgcagacaccgatgaaatcaggctgaaaaccacccacggaagcgccaccgacggcctgccatccagcagggggaccacatacgggtacacctgcccgccggcaagatgcgccagataaggatacaaatccgcctccgtcatcgtctcagtacctcatcaatggcccggttcatccgcgcaatcgccacctgagctgcctgttcactgcgcacatcaaacgccgggcgcacaaacgggtgcggtggcatattcacggtccccatttccacaaaccgccagtagaaagcattgcgcgggttatccgccttcatggtgttatcgctgttaccggtgtccggattaacaccacggatatggacaccggattccatcccgccatcgcgggagcgccgggaaaggaccaccacattgcggcgcagttttcccctgcgtaccggtgcccgtgacaccacttcttctttcagcacattcgcacccgcacgggttgcctcacgcagcacccggttattttcngcaccactcagaagctgcaaatcgcggctgatgtcctccagccccgaaaaatccagcagggtttcgatcatttttcccctcccagccgacagagaatttccagacgcccgccggtcgcatccggnacgggcagcccgacaacgttcaggannnggtcacgccagggaccactcagcacatgaagtcgtgacgctgccgtgatttcccgaccggactgaccgcgcacccagatgcggatttccgcctgcgccatttccgcaccggactgcatccgctcccggctgctcctgccccggatatccgcatgaattttcccgcatgacacccattcttccgtcatttctccggcagcattacgggttaacaccgggttcagaacacttatcatctgtgtcagacgacctgcagatattgccattccccctcctcataacaccgtcggacaacgcaaatcgtaaatcagcacggacacagaaaacggcagttccccctgcacgaggtcttcccgctcagcaagatccggattccggtacagcatcccggtcagtcgcatggcagcccccttcatccgggttaatgcctcgcccgggatcagctcaccgtcctcacgaatcaccttatcccggctgccctgaatgtaggccagcagcacggcggtagcctgacgaaccttgtccatcagcatgtcatcatccgcgtcatggtcgacacgcagatgtgccttgatctcttccagtgtcagtaatgccgtcattttccgcctcctgcatcccgtccacgtttggcagccagggtccagcctgatgaatgagcttctccgggtttatcaccggtcatactgttgcagtgccacagcgagcccccccacgtcaccgtatcaccggggtggtaggtttcaccggctctgaacacaccgcggtagagcatcaccggcagggaaaatgttttttccgtacgctggccactgctctgccggaccaccacagtgaacgaccgttcgccggtcatgctgacgtcaatatcggccaccccgtcaaccaggcattcccatccccgcatcccgtgcgttttttcatacgcccgccagagtccgccctggtgtgtggcatacgtgccccggggaaaggatttttgatcgtcaatggcggggattatttccagtgccgtggcatcacgcccgtcctgcggagccggcagggctctcaccgcatccagaacagccttctgcagaacatcgggatcatagtcacgaccatcacgcggaacaggaatatggcttaccgcctctttcaccatctgttcaagcatcggacgcacatcatcgggggtaatacttttgccgtccgccggtaccggaatattcgcaaccgcatcattcaccgcctgcttcagtacttccggatcataatcacgaccgtcacgcggagcagggatatggcttacagcctctttcaccatctgctcaagcatcggacgcacatcatcgggggtgatacttttgccgtccgccggtaccggaatattcgcaaccgcatcattcaccgcctgctgcagtacatccggatcataatcacgaccatcacgcggtaccggaatggtccccacagcgtcatccaccatcgcctgcagaaccggatgtacctcatccaccgtcacatgcttctgtaataccgccgacagggaagccagtttctcttcaaacgcttgtgcctgcgcggccatcttcccctcaaatgtgcgctgtaaatccgccagcaccgtggagaattcttcgcccagtgcacgaataatggacagttcccgttccgtcattttctcagtatccccctgaacatcgctttcactgcatcatgctctgtttcactgattgccttattaccgtcagatgcgccgtcaggcagttgtgctgaaactgttttcccggccgacgcgaacgggtcctcacgggcatcacgacgggacagcgcctccagactgtagttctgctgctgaagatacagtgcatcaccgccggcaaggggcggcaggttctcacgtttacgggcctcattgggcgtgagaagcgtatttttcaccgattcacccagtgttttcatgcgccgttcgctgtccattctcagcagcgtggtgacgtcaaactccgtgctctcgttttcccccgtttccagcgcctcatccagtaacagctcaatggactcaatcagcgtctgcaggcactgggaataatactgctgctccagcgcctccacgttgtcactggaaggcgggtggccaacgccaatcttgtaggccgggacacggaacaccgaacagacaatttcagccgtcattttcagttgttccaccgtctgcgcatccaccggtgaaaacgtcgtggggctgtattttgccccgttgctcagtatggccgtcttcccggcattttcgcccgtatatccgctgtcccagttccccttcagttttttcgcgttttcttccgtaatactgccggggacctcaatcacgcctgatggtcgcccgccatttctgaaaaaatacgtcgaatttgcctgaatatgatgcccctgcatggcggccagtcctgcggcatacaccggcggcagccccacaagcggatgaaaaaaacagttaaaacggtngtggatcacctcccgggcaggcaccgtcaccgantntgtgatcccacagttccggtccggcgtgatgcggtagaacacntcgccgtcatccgccaccagaggttcaacccggttccagtccagaatacgcagttctttgatctgcccccggggggtgcggattttcagcaccaccgtattgccgtgacgcaatttggaattcagccacagttcaaaaaactggatgcgattctgctgcgcattaggacgangacagagacgggcagtatctccctgccgcttttcccggcgtattccctgtacatcagtctgcatcaggcgaagccgcattttggcaatatcctgggatatcagcgaaatgcatgaaaacaccgcgtgaaaggacaaaacggtttccggatcggctttcaccccctgctgccaggcaccggcaaaaggctcagccaccgcctgaaacagggaccgccagcccacttctcttacgtcacgtcctgatttctggttttttcgggttcgccgcaaaaggttccacattcgccatgctccgcatcacgtttctttttctgacctgccggacgtcgcgctgtgatgtactccgccttccccaggcgaaccancacctccgcacacggctgtgccacatcacggatatccccggcccgggcatcatgcgtgccctgcagatatcggatctttgccataacctgttacgggaggcgcacgcctcccgtcctccttatcagactcagccgccggacgcactgccgtagttcactccggtgatcaccgccaccgccgcagtacggcgacgacgccagttgatccagcgctccgcacggatggccacgctgcctgtctggaacatggaaaccagctccaccggggacggcgtggtactgtcgccgcccggctcagactgcatttccagtgatgcctcgcgggacatatccactgccacgccgccgtcatccgccagataaatatccggggcattcaccagcaccagctggtcacccacgtactgggagacaatcaccggcagcccctggaaggagccacccagcagggtcatgtccgggtattccttctgacccagcgcatttttacgcatggacagtgccagggcattggtgctggacatcagccagaccgcaccggtgggctgcaggtttgctgccacaaactgtccaaacgcagcctcggcatccgcatccgggttaccggttgatgccgtgcccttcacatcatgggtgatggacgccggggagacatctgccactgcggcttttttcgggtccacaaagtctgtatccagacgcgccaccaccgcttccgccagcgcattacggaccagtgcatcagcagccggactggaaaaacggatcaattcttccgtcagtaccgcaatggccgacaccttcgcatgactgaaggtgatggattcaaaatcaaacttcgtcaggggttttgccttaccctcacccacccagccggcagcaccgccggacacctgggcgtgcacacggatattgaatggcacctgacgaagtgcagggatcccgccctgaccaaatcgcccgataatggtctgcggacgcaggtaatcaataaagtcctgtgcgtattcctgatattcagacaggctgcctgcccactgcggatccgtggtggtccccgcgcccactgccgatttcaggacatgatgcagacgactgtcatccggatactgacgacgggccacttccagggcttcagatcggacgcctttagccgcagccagcgatttggcaaagcgggcgaagccaatccccttatccagtttctgctccacacggatcaccggcgcagaagccaccgcggccacattcccgttaccggcctgtttcaccggctgcgccgtggcggccttaccggcttccagttcacgcaggcgcttcaggtgcgcatccacctgacggatttccgctgcggtgttgtcgtaatgctcttcctcctccacatccagcgtgcgcccttcctctgcggctttggtcatgacctcctcaagggaggctgccagcgctgcacgcttgttttcaaaacttttaatctgttcgccaatattcattatggtcttttccttatgaaaaacggttgttgactgtgccgcagcgccggcagaagatgcgattttcaccaccggtttccggttgccggacgcggcagaaaacgggcggtcgtaagatttaatggtccggatggtgcattccgcattcgcgggcacggtgacggcagacacctccatcagttcccagcgcagaaaatgcagtccgcctccgtccagaaaggtgtattcatggggacggaagcccacggacagccccctgaccagcccggtcttaatggccgcccagacctcatccagccgggcagccagttgcgacggcatatccggtacgggcttcaccagtgttgccgtgatttccagcccttcgctgacccggcgcaccgtacactgccccaccgggcgggaatggtcatgctgccagagaaacgggatcgcactgccaaactccgcgccctccggctccaggatgtcaccatcccgatccggagaaggcgttgacgcaatcccggtgatcacccgttcatcctcactgaaggatttcaccgtcagcagggaacaggcccgtttaagagtcacatcagcctcctgaaaataaaaaaaccgccgcagcggttcatgatggttacagtgtgaacagggttatatgaaaaaaaccgcatattctttctttttcggttccgggttaagggacatcaggagaccgcattgaacagcgccatcagcgggtcaatttttccccgtccactggcctgtttggtgataagaatggcgttacctttaggctccacccgggcattgccgacacaccaggccatcaggggctggtcaccatgcaccagcaccccttcagccagtttgcgctcggtggttttaatggccccgcccagtttccagccctggcttatccccaccacaattccgtcggggatcccggcttccgccagtgaatccagaatctgccccacccctgacgggtcaataccgatatggtccagtaactcagcctcatgaatgcgacgcacatattccgccacttccgccgtgtcatccccgacacgccggacaatggtcatatctccacaggcaacaagatcctgaaaccgggacgcctcgctcttccgtcggaccaccgcggtttcatgcgcccaggcatggccccagcccagccattcgcgggtttccctgtcacggccagtcacgtacattcccagcagatcatccaggcccccgccgtcaatccccaccgtcaccacatcagcgcgctgcaggatatcgtccaggctgacgcgcctgccctgctgctcccagaaatccgcacccgcccagcggtcagaacgcagggcaagaccaatttccacattggcatgttttgacatgaagccacgaaatgcttcctcaccagcctcccgggctttacggtactcccggtacagaaaagcctcatccaccgaataaccgagattcgggttaaccatggcgaggttttccatcagcaggtgagccccgctttccaccatttcaggaggatgctcaaaaatcaccggcagaaagtgcggatcatgaattttgccgtcacggacatcccgggcgtactgcagtttctgtctgaacaccccggctggcggctcattcgactgggtggtcgtatacaccacaaacccttccgggcgggaggcaaggccgcctatggcttcacgtaacatgtcctccgctttgtactgcttgccaaataaccacagttcatcaatcagcgtccccacggacttgataccggataccgtattcggatcggcagccaccaccttcagggtggtgtccgtcaccctgtgggtgatggtccggatatgtgtctgcacctgacagaggtcatccagatcatcgtcccgtcgtaccatatccctggcagggttgaaggcgttagccgccacctccacggtcggggccagaatggtgtagcccgccgcctgccgccagttcagtaacagcgccgtcatcatgatcccggcagccagcgtggacttgctgtttttcttggggataaggataaaaacttccttgatatggcgtacaccggtctgcgcatcgtaggagccaaacagggccgccaccaggtcaaacacccactgtgcgcaggactccccgaacgtcgggctgcccggtgcatccacaatccgcagttgtttaaaaatcgccagggcatgtgcggcctgctccggataaatcggagccggaataatcgacagcccctttttcaggcgctctgcccagtccgggcaggccgtgctccacacaggtatcatccgttgccctcattatcattattcaccaccaggcggggtggtggtggcaccgcaaaacggttagccgcttttttcgccgcgtcaccttttgccgattttttaccggcatccccttttttgtggtgcgtgaactgcgccagcttataagccgcatccagcgccagcctggggtcggtattaatgttctccaccagaagacgccccatcgctttcaccggatcgggaagaccgtcctccatatactcaataccaggagatatcaccacgggcggtggcatctccggatttgtttcgtccggctgtggtattgcagccgcctcacggcgacggggtttatcctccggctctgattttttctgccgataaacaggaacctcatccacctccaccgtctcgcactgtttacgggctataaacgcaagcacctccggatcttttgccagctgcgagcctttaaccctggctgtcttcgccgaataaccggcggcaagggctgacgctgttttgtttttcccggacatgagcgccagcgcaaattttcgtttttgcgttgtcagcacagcctcctcccgggtccagaacgcactcagccgggtatggttcagcccatttttcccggcgtctcatgccgcaaatgttaactgctgcctggttaacatttgctgaaaaagcctgttaacattttttccgcacaacaaactgaataataaagataaaaaccgcaaaaatgcccgggcagccagttaacatgttaactgccctgaaacgggaattttttctctgcgtgagagggggcgcggtgtccagggcgatcgttttttttcgccggatgatcccccccgggtctggtcacaggccagtgattccgtcggccctgagcgtgccatcaggaagctcaggcaacgtcggatcaggcataccactcgccgcttcactcgctgacttctggcgatggcattcagtacagagggtccagaggttcgtctcctcattaccaccaccgaactgaagtgcaatgcggtgatcgagttcactgtcacaaaggtcaaccacgcgtctacagagacaacagtgtccggcatccctccgccagatacgacgtttgagggaaacccgggcactgccactgacacgacgctgttcccccctcaggacatttatccgccgggtgttcagagttttgattctgcccggtaacgtacgaagcacagccatgtaaaatcctcgccatatagcttgtcaccagaggaaagaaaatgtcatcgaaaaaccggccccgcagaaccacaatccgcaatatccgtttccccaatcacatgattgaacagatcaatatcgcccttgaacataaaggttccggtaacttttcagcgtgggttattgaagcctgcagaagaaggctgtcaacagagcgttcgggtatgaattacataattaagtaacatggtgttcacagaacacacagttaccggacacatcagttttccattcgtcccccggcagtacaggcttcccgtctgacgggatagcctgaaaaaacacagaaaattatttgttataattaatataacttactcaaaaaaagcgacgagaaaatcagcatcaacgagcaataagcgccaatacgtgataacaaatggcagccatatttatctgcagtataagcaatggacaggataaccacaccagaaaccgtcagcataaaatccatttgaacttcctcggacaaaatcgactcatctaaagatttacagctctttttattatcaatatgttaaaa

SEQ ID NO: 253 - DNA  (genomic), 5836 bp; double-stranded, linear
catcactgctggtgtaggccacaccacatctgacggacggtcctgcacaaacgtcagcgtctgcccgttccataccggcatacagcgcatcgccgagcagaaatcactgagaacgtcccacgccttacgctgttgtgacaggtacgcattgaaagtcatccgcggctctgtgcccccgaaaccatccgggaccgtctggtcgcagtactgcgcaatggcatacagcgcccacttgtccacatccgccgcccccaggcgttttcccattccgtagcgcgggtgggtcagcatgtcccacaggcaccaggcagggttgttgctgtatgccggtttcaggctgccgtcccagatgccgctgtacgtgcgtttttccgggtcatagtttgacggtacctggatgatgcgaccgcggatatggtagttcaccgtcatctgctgaccgccaaactgctccgcatccacctgcagccccacaatcgccgtgttcgggtagcactgtttcacatcgatgatttcggtgtatgacgaccagagcgtcttattctgcagctggtccgaggtgctgtccgctgtctcccggaccatccggatgttaaagggccgctcaggcagattatccagaatcaccgacgccagaaactgcgaggtggtcttgccgttaatggtgacatccttttccgtcacccagttaccgttacgctgcaactgaatcagcagtcggacagaagagtgattacggtcgccctttgaggtggtctccaacagtgactgcaccccgaaggtgacccgcaggcggtcaatgttcgcggacgtaatggtgcgcgtcaccggttttgccttcgtcacttccacgcccagtccggtttcagctccggaggactcaaagccttccggtggtgtctgctcctgctccccggcacgccagaccgcggtcacaccgtgtatcacgggattgccgtccgtgtccgtcagtggggttttgttcaccagaatactctgcagtcccttcaccggaccttctatcggtccctcaccaatcgcatcaatcacactcatcatctgcgtggatttgagattatccttcgcctcacgaggcgtgtgtgccttaccgccaccttttcccatacagccttcccctgaataaattaaccgccacttgccattccgtacagaagtcggatatccttcgcccgaaaagcatgaaacacatttctgccatgctaaagaaaaccccggtatcagcagataccggggttttctttcatgcccaccgataatcctgttggttaaaaccggtaatggcataaaaattctgaatatcttcacattttcacacactgactgtggcgcttataatttcgctgcgttagtgtttttttgcccgagtaacaaaaacaactccttaacattgatcttcatttgtctgtccccgcagctccgcgatcactgcgggatttttttatgttttatccctgtcgcccgacaaccacgaccgttccgcccccgccttcatcacgggtgctgatgtcctgggatatacggcgggagccaaccagcatttccccgtaaggcaccggcatcgggttcccctgggcaatcatgttatccagcgaggaaaagtacgtgttctgtctgccgttatccgttgcgcggtaatccggtgtttttgccttcggggccagcatctgggccacaccgcccagaatcatgctggctccaagtgaaaacagcatcgtggtggcagaaaaaccaccggctgccagggctgaaccccataacgccattgatgccccggcagtgaagaaagagcccacgatggctgccgcccccagcacaatctgcagtccaccctttccggccccggccagtcgcggcacaatatggatgaccgttccctcacccagctgttcgtgaagacgggcgtacaccgcctccggtgccgtgtcataaccggcaatacgtatctggtaccagccttcgttcatctgacggcgaaagcccggcacctgtaacgacagcgcccggatggcttccgctgccgtgttcacatacaggctgaggcggcggccaaatcgttgtaaatccccgtgaaggcagatacgtgccagtggcggtgacgccaggctgaatgcgttcgtcgttgccatttttcggaatacctctcccgtttactcagttgttcaggcagatggtgaagcagttcaccgttgccgcagtatatggcggcatgattggccaccgatgcgccaaagcagcacagcaggatatcgccaggctgtgcggaaggcagggaaatcctgtaaaaaccagtcgcctccatattgtccaggtacaggttctgaccattgcgccaccagtcatcctcacgctcaaaatccggcatatcagtccccgccagatgataagcatcccggaacagcgtgtaacagtccgtcaccccgtgctcaaagcgccgtcctgtcagatgtggcacacagcggaatttgtgaatgtcaccccggcagaccagccaccagggcagtgcgctttttatctgcagccgccggtcagcctcgctcagccagggcagcccaccgggatgactgtggaccagtgccacaatctccccctgcatctctgcccgcagccagtcttccggtgcgatacgaaaatacgcctccggctctgcagaaatattcacacaagggatataccactccccctccggcgtgcttatcacgaagccgcacgactccgcaggcgcacaccgccgggcatgcgccagaatcgctgattcagtctgtgtcataaaccgggatttactgcgaaagtttattaatggaaaggaaaccgccaaaattagccaccatgctgcgcatctcacacccgcgcatgcacttgctgcatctgtccttacggatatccgtggtggggttgtcgaactcatccgccactgccccgcccgtgtaaccacactcatcagagcggtaggtccacatacaggtattcgccagcataatgcgaccgggaaacagcgctccgtccgtctccgtcggtgttgccagcacaaacgaggctgtcatggccgtcagctctgacatctgctccaccacccagcggtctctcagctcctgctccgggtccgcttccggattgcccgccacaaaattcaccgcatccagaaaacgggcatacacccggcggcggaccaccgtggcacccaccaggctctgcaaatcctccgccatcccggtgacaagaccgaacagattggacaccgtcagcgacgggcgggcactgctgcccttcccgttcatctcaaagccactgccgtcaatcgggtatacctgatattgccgcccctgccaggtgaccgcctcccctttttcattcagctcattacagaaaaaataccgctcaccgccctgcaccgtcaggtcgatttcccagagcaccacccgcggtgactgctctgacttaaccgactcgttcaggctttcttcatgaatattctgcatcagttcaccacctgctctatcgtgcaactgaaatcactgtaccgggcattatccgtgacactccactcacggcacacaaccctcaccgtccggttatgtttcggcggtcgccacaaaaaggcacggtaaccaccatgccaggataaaaattcatccagccagcgccgggttgactcatccgtcacccggaacaccgcctgaaacgtcttcagttgaggattcagccctgtggggcggcgctgttcataaccgtcaccaaaccgcaccctcaccaccgacggcttctcactcacctgcatcccttcacgcgggaccagatgcagcgtttttatctcagccactcagcattcctccgtcacgtcgcatggacagcatcaccgcctgcacccgctggtcaatcagctgcacaagactgcctgccgcctccggccctatctgtccgttagccccgtcattctgaatggcaatgtggtagaccggggaatacaccagaccagcactgccgttcatactgcccacggcgcgtacgcccagcgagccatccgccgcccgggtcaggggcataatagcttcaggtccggcttcccccatcagcccggccccttttgcaaacgcaaagtacgtgggcgtgtccacaatgctgttgctgtacgcgctcaggtttgccgaggtatacacgccgccttttgcattggccaccgctccgcccagccagtcaccaatgctgccgagaaatcctcccgcaccggacataccgtttgccgccgtcttaattccgttgacaatcgcggcattcataagaacttttgatatttcctgcagtacggatgaggcccagctgcgccattccactttatttccgttcagcatctccgtgatgttattcaccatccctgagataccctccgtcgccagctgtgctgcctgtgaggcgtaatcggacgcattatccacccagttactgaatccctcctgcagccctttctgccagtccgcacgctgcacatccgattcggcataaaagactgcctggtccttaaggcgttcgctcagatactgcgcgttctgtgccagcgcctgtctgtaaaaatcctcactgatatccccggtctgatactgagactgaaggtccgcatccttctggcggaagctgtcgcggatctgctgcaactcccgcatgcgttccctggctcgttccccctgcccgtaccccagcagttcagattcatttgatgcacgcgcagccacattatcattcttcagggtctcttcccggtaccgcaactgctcccggattttttgctggtcaatcagggccgcattgcgcagcagttcctgcttctgtatctccgacagggttttcagttcacccagcgctgtctggtacttcagcttcgccagctccgtgttctgaccggccagtgccagttgctctttctgctgcttcagcagccgggaaaaactgtcttccgctttttccgtctctgattttccaccccgggatttgggtttattcacctcgttattgcgccaggcttccagggcattactgatataacgttgtctcgcctcctgatacggatcccccacaaaaccgaggtcatccgccgcataccccagtcggacgcgctctttttcttcccctttcagtctggacagggccagctcacgctctgtttttgtcagggcactctgctgtttatcatccagagtggcctgtggcagccgtaacggcacattcaccagtccctgccgctgntgaagcagttcattccccagccccagcagacggttgaattccgtatactgaccgttcataaccagcatggactggtacaccttattctgctctgccgcctgctgacgaattaacgccacacgacggtcttccagcccggcaagcacatcctgaatggactgcgctttttcctgcatctgtgccagacgggactgctcaacggcaagctgctctgttgcctgagcaagcccttccgttacggtcttcaccgatgtcagatggtttatcatgaatccgtcaccggtcgtccagcccgggttcgccagaacatactgatatcctgcgattttttcctgcagggatttcacccgactggcctgttcatcaatcagccggttctgctctgtcagcgccgcccgtgttcgtccttcattatctgaggcttcaggcaaagacattgacggcgttttatgcgcgatttcatctatcgtcagtgcatactggcgcgcagactccctggcctgctcctgattctggtacancgtgtaccatgctgcagcccccagcatcaccagtccgggtacgccaccaaccancccca

SEQ ID NO: 254 - DNA  (genomic), 11481 bp; double-stranded, linear
aggcatttgatgaggcggataaaaaatggcagtggtaccagagccggagccagcgccggggaaaaaccgcctctttccgggccaaccttcagggcgcatggaatgaccgggaaaatgcccgtctggggctggcagcggccacgctgcagtcggatatggaaaaagccggtgaactggccgccagggaccgggccgaacgggacgcatcacagctgaagtataccggagaggcgcagaaggcgtatgagcgtctgctgacgccgctggagaaatataccgcccgtcaggaagaactgaataaggccctgaaagacgggaaaatcctgcgggcggattacaacacgctgatggcggcggcgaaaaaggattatgaatctacgctgaaaaagccgaagtcgtcaggagtcaaagtgtcagccggtgagcgtcaggaagaccaggcgcatgctgccctgctggcgcttgaaaccgagctcaggacgctggaaaaacacagcggtgcgaatgagaaaatcagccagcagcgtcgcgatttatggaaagcggaaaatcagtatgcggtcctgaaagaggctgccacgaaacggcagttatctgagcaggaaaaattcctgctggcgcataaagacgaagacgctggagtacaaacgccagctggctgagctgggagacaaagttgaacaccagaaacgcctgaatgagctggcacagcaggcggtgcggtttgaagagcagcagagcgcgaagcaggccgccatcagcgcaaaagcccgcggtctcactgaccgtcaggcgcagcgggagtctgaagcgcagcgtcttcgggacgtgtacggtgataatccggctgcgctggcgaaggccacatctgcactgaagaacacctggtctgcggaggagcagcttcgtggaagctggatggccgggctgaagtccggctggggcgagtgggcggaaagtgcgacggacagtttttcgcaggttaaaagtgctgccacgcagacctttgacggtattgcacagaatatggcggcgatgctgaccggtgcagaggcagactggcggggattcacccgttcggtgctgtccatgatgacagaaatcctgcttaaacaggccatggtgggcattgtcgggcgtatcggcagcgccattggcggtgctttcggtggtggtgcatctgcttcctcggggacggccattcaggctgcggcggcgaacttccatttcgcgatcggaggatttacggggacgggcggcaaatatgagcctgcgggaattgttcatcgcggggagtttgttttcacgaaagaggcaaccagccggataggtgtggggaatctttaccgtctgatgcgcggctatgcggaaggtggttatgtgggtggtgccggaagtccggcgcagatgcggcgggcggaaggtattaattttaatcagaacaatcacgtggtgattcagaacgacggcaccaacggacaggcggggccgcagctgatgaaggcggtgtatgacatggcccgcaagggggcgcangatgagctccggctgcagttgcgtgatggcggtatgttatcggggagcgggcgatgaaaacctttcgctggaaagtgaagccggatatggaggtgaactcgcagccatcggtgcgtgaagtgcgttttggtgacgggtactcacagcgtatggcggcagggctgaatgctgacctgaaaacataccgtgtgacgctttccgtgacccgggaggaggcccggcatctggaagcgttcctggcagagcacggaggctggaaggcatttttgtggaagccaccctatgcataccggcagataaaggtgacctgtgccgggtggtctgcgcgggtccgggatgttgcgcgttgagttcagcgcggagtttaagcaggtggtgaactgatgcaggatattcacgaagaaaagtctgaacgagtcggttaaatcagagcagtcaccgcgggtggtnctctgggaaatcgacctgacggcgcagggcggtgagcggtattttttctgcaatgagctgaatgaaaaaggggaggcggttacctggcaggggcggcaatatcaggcatacccgattgacggcagtggctttgagatgaacgggaagggcagcagtgccagaccgtcgctgacggtgtccaatctgtttggtctggtcaccgggatggcggaggacctgcagagcctggtgggggccacggtggtccgccgccgggtgtatgcccgttttctggatgcggtgaattttgtggcgggcaatccggaagcagaccctgagcaggagctgagcgaccgctgggtggtggagcagatgtcatagctgacggccatgacagcctcgtttgtgctggcaacaccgacggagacggacggagcgctgtttcccggtcgcattatgctggcgaatacctgtatgtgggattaccggggagatgaatgcgggtataacggtcctgcggtggcggatganttcnacnaccccaccacggatatccgtaaggacagatgcagcaagtgcatgcgcgggtgtgagatgcgcggcatggtggctaattttggcggtttcctttccatcaataaactttcncagtaaatcctgttttatgacacagactgaatcagcgattctggtgcatgcccggcggtgtgcgcctgcggagtcgtgcggcttcgtgataggcaccccggagggcgaacggtaccagccctgcgtgaatatctccgcagagccggaggcgtattttcgtattgcgccggaagactggctgcaggcagagatgcagggggagattgtggcgctggttcacagccaccctggtggtctgccctggctgagcgaggccgaccggcggctgcagataaagagtgccctgccctggtggctggtctgccggggggaaattcataaattccgctgtgtgccgcacctgaccgggcgtcgttttgagcacggggtgacggactgttacaccctgttccgggatgcataccatctggcggggataacgctgccggattttgagcgtgaggatgactggtggcgcaacggtcagaacctttacctggacaatatggcggcgactggtttttaccgggtgcccctgtcctctgcacaggcgggcgatatcctgctgtgctgctttggcgcatcggtggccaatcatgccgccatatactgcggcaacggtgaactgcttcaccatctgcctgaacaactgagtaaacgggagaggtattctgaaaaatggcaacgacgaacgcattctgtctggcgtcaccgccactggcacgcatctgccttcacggggatttncaacgatttggccgccgcctcagcctgtangtgaacacggcagcggaagccatccgtgccctgtcgctgcagatgccgggattccgccgtcagatgaacgaaggctggtaccagatacgtattnncggtgaggacacggcaccggaggcggtgtacgcccgtcttcacgaacctctgggtgagggggcggtcatccatattgtgccgcgactggccggagccggaaagggcggactgcagattgtgctgggggcagcagccatcgtgggctctttcttcaccgccggcgcaacgatggcgttgtggggcgcagccctgagtgccggagggcttgactgccaccacgatgctgttctcactgggtgccagcatgatactgggcggtgtggcccagatgctggcaccgaaggcaaaaacaccggagtacagggcgacggataacggtaaacagaacacgtatttttcgtcactggataacatgattgcccaggggaacccgatgccggtgccttatggtgaaatgctggttggttcacgacggatatcccaggacatcagcacccgtgatgagggcggagacgggaaagtggtggttatcgggcggggatgaaaataaaaaaatcccgcagagttagcggagctgcgggagagaacgatgaagattaacgttatggagttatttttcaggcatcaaaaaagtaatgcagcgtcattattgcggctacaggcaattgccggaaatgtgaagagtttcagaaattttattccgtcatgacacaggcaccctccggggtgcctgttgttttctggcataaacagattcagacatcagacaggagagggggacagagtgggtaaagggggcggcaaggggcacacgccggtagaggcaaaggacaatcttaagtccacgcagatgatgagcgtgattgacgccattggtgaagggccgattgaaggtccggtgaaggggctgcagagtattctggtgaacaaaaccccgctgacggacacggacggtaatcccgtgatacacggtgtgactgcggtctggcgtgccggggagcaggagcagacaccaccggaaggctttgagtcctccggagctgaaaccgcactgggcgtggaagtgacgaaggcaaagccggtgacgcgcaccattacgtccgcgaacattgaccgcctgcgggtcaccttcggggtgcagtcactgttggagaccacctcaaagggcgaccgtaatcactcttctgtccgactgctgattcagttgcagcgtaacggtaactgggtgacggaaaaggatgtcaccattaacggcaagaccacctcgcagttcctggcgtcggtgattctggataatctgccgccccggccctttaacatccggatggtcagggagacggcggacagcaccacggaccagctgcagaacagaacgctgtggtcgtcatacaccgaaatcatcgatgtgaaacagtgctacccgaacacggccattgtggggctgcaggtggatgcggagcagtttggcggtcagcagatgacggtgaactaccatatccgcggtcgcatcatccaggtgccgtcaaactatgacccggaaaaacgcacgtacagcggcatctgggacggcagcctgaaaccggcatacagcaacaacccggcctggtgcctgtgggacatgctgactcacccgcgctacggcatgggaaaacgcctgggggcggcggatgtggacaagtgggcgctgtatgccattgcgcagtactgcgaccagacggtcccggatggtttcgggggcacagagccgcggatgactttcaatgcgtacctgtcacaacagcgtaaggcgtgggacgttctcagtgatttctgctcggcgatgcgctgtatgccggtatggaacgggcagacgctgacgtttgtgcaggaccgtccgtcagatgtggtgtggcctacaccagcagtgatgtggtggtggatgataacggcgtggggtttcgctacagcttcagcgccctgaaggaccgccacacggcggtggaggtgaattacaccgacccgcagaacggctggcagacntccacggaactggtggaagacccggaagccatactgcgctacgggcgcaacctgctgaagatggatgcgttcggctgtaccagccgcggtcaggcccaccgtgccgggctgtgggtgataaagaccggactgctggaaacgcagacggtggatttcacgctcgggtcacaggggctgcgtcacacacccggtgacattattgaaatctgtgataacgactatgccgggaccatgaccggcggacgtatcctgtccatcgatgccgccagccgcaccctgacactggaccgtgaggtgaccctgccggagaccggtgccgccacggtgaacctgattaacggnagcggtaagcnggtgagcgtggccatcantgcacaccccgcgccngaccggatacaggtcagnaccctgccggatggcgtggagacatacggtgtgtgggggctctccctgccgtnantgcgtngtcgcctgttccgctgtgtctccatccgggaaaacacgacgacggcactttgccatcacggcggtgcagcacgtaccggaaaaagaagccatcgtggataacggtgcccgctttgagccgcagtcaggcaccctgaacagcgtcatccctccggcagtgcagcacctgacggtggaggtgagcgcagctgacggtcagtatctggcgcaggcgaaatgggacacgccgaaggtggtgaagggcgtgagctttatgcttcgcctgaccgtggccgcggatgacggcagtgagcggctggtcagcacggcccggacgacggaaaccacataccgcttcacgcaactggcgccggggaactacaggctgacagtccgggcggtaaatgcgtgggggcagcagggcgatccggcgtcggtatcgttccggattgccgcaccggcagcgccgtcacagattgagctgacaccgggctattttcagataacagcggtcccgcgtcttgcggtgtatgacccgacggtacagtttgagttctggttttcggaaacgcggattaccgatatcaggcaggttgaaaccacagcccgctaccttggcacggggctgtactggatagccgccagtatcaatatcaaaccgggccatgattattacttttatatccgcagtgtgaacaccgttggcaaatcggcatttgtggangctgttggccagccgantgatgatgcatccggctatctggattttttcnaaggaganatngggaaaacccatctggctcnggagttgtggactcagattgatnncggtcagcttgcgcctgacctgncgganatcagaacgtccatcacggatgtcngtnatgaaatcacgcanaccgtcnatnagaaactggaagaccagagtgcagcgatccagcagatacagaaggttcaggttgatacaaataataacctgaacagcatgtgggcagtgaagctgcagcagatgcaggacggacgcctttatattgcgggtatcggtgccggtattgagaacacctctgacggcatgcagagtcaggtgctgctggcggcagacaggattgcgatgattaatcctgcgaatggcaacacaaagccgatgtttgttggtcagggcgatcagatattcatgaatgaagtgttcctgaaatatctgacggctcccaccattaccagtggcggcaatcctccggcattttccctgacatcagacggaaagctgaccgctaaaaatgcggatatcagtggcagtgtgaatgcgaactccgggacgctcaacaacgtcacgattaacgagaactgtcgggttctgggaaaactgtccgcgaaccagattgaaggcgatctcgttaaaacagtgggcaaagctttcccccgggactcccgtgcaccggaacggtggccatcagggaccattaccgtcagggtttatgacgatcagccgtttgaccggcagattgttattccggcggtggcattcagcggcgctaaacatgagagagagagcatactgatatttactcctcatgccgtctgatagtgcggaaaaacggtgctgaaatttataaccgtaccgcgctggataatacgctgatttacagtggcgttattgatatgcctgccggtcacggtcacatgacgctggagttttcggtgtcagcatggctggtgaataactggtatcccacagcaagtatcagcgatttgctggttgtggtgatgaagaaagccaccgcaggcatcagtatcagctgaattttataacccatatacgggcgccagaaatggcgccttttttattgcagaaaagcgagaggtaattatgcgtaaactttatgccgccattttgtccgcagccatctgtctggccgtatccggcgcgcctgcatgggcgtctgagcagcaggccacgctgagcgcggggtatcttcatgcccggacgagcgctcccggtagcgataatcttaacgggattaacgtgaaataccgttatgaatttacggacacgctggggctggtgacgtcattcagctatgcaggagacaagaatcgccagcttacccgttacagcgatacccgctggcatgaagattccgttcgtaaccgctggttcagcgtaatggcggggccgtctgtgcgcgtgaatgaatggttcagcgcgtatgcgatggcgggtgtggcttacagccgtgtgtcgactttctccggggattatcttcgcgtaactgacaacaaggggaaaacgcacgatgtgctgaccggaagtgatgacggtcgccacagcaacacgtctctggcgtggggggctggcgtgcagtttaacccgaccgaatccgtggccattgatattgcttatgaaggctccggcagtggcgactggcgcactgacggtttcatcgtgggtgtcggttataagttctgattagccaggtaacacagtgttatgacagcccgccggttcaggcgggcttttttgtggggtgaatatggcagtaaagatttcaggtgtactgaaagacggcacaggaaaaccggtagagaactgcaccattcaactgaaagccagacgtaacagcgccacggtggtggtgaacacggtggcctctgaaaatccggatgaagccggtcgttacagcatggacgttgagtacggtcagtacagcgttattctgttggtggaagggttcccgccgtcacatgccgggaccatcaccgtgtatgaagattctcaaccggggacgctgaatgattttctcggtgccatgtcggaggatgacgtccggccggaggcactgcgtcgttttgaactgatggtggaagaagcggcgcgtcacgctgaggaggcgaagaagaatgccggagaggcggagacgtccgcgaggaatgccggcatatcagccagtcaggcagaagagagcgcggcaaatgctgacacttcagcaggggatgcatcggagtcagcccggcaggcggcagaaagtgcagccgctgcaaagcagtcagaggaggcgtcctcgtcctcggcctctgcggccgctcaaaaagccagtgagtcatcacaaagtgcagcagatgctgagttgtcaaaaaagacggcagaaagtgcagccgntaatgcacccagggatgcaacgaccgcaacagaaaaagcccgggagtcagcagaaagcgcacagtcagcggaacaaagcaggatagcggcggaagaggccgtaaaccgaatccccacggtggtggggcntcccgggccaaagggggaaccgggtcccgcgggtcctcaggggccgaagggtgataagggagagcgcggtgacaccggccctgtcggggcaaccggcgaacggggaccggcaggtgatgatggtccggcaggcccgcaggggccgaaaggtgacaggggagagcggggagagaccggtctgacgggaaatgcaggtccacagggtccaaagggagacaccggggcagcaggcccggcaggcccacagggaccgaaaggagaaacaggtgcggctggcccggtgggggcaaccggacctcagggaccgaagggcgacccgggggagacacaaatccgttttcgtctggggccggcgagcattattgagacaaacagcaatggctggttcccggatacagatggcgcactcatcaccggactgactttcttgaccccaaagatgccacacaggttcagggtttttttcagcatttgcaggtcaggtttggtgacggccgtggcaggatgttaaggggctggatgaagtgggcagtgatacaggcagaacaggagaatgacatgaacgtactaaaaaaacttatgcagcgtctgtgcggttgcggaaagcatgatgaccgtgaacacggggagttacttacagcacaactgcgtctggggccggcagacattctggagtcagatgagaatggcattatcccggagcagccaggtaatcacgcagtgtgatactggatgcggataaaaagcagatacagtgtgtggtaagaccgctgcaaatcctgcgtgctgacggacgtgggaaaatattggcgggatgaaatagccgacgagttcacaaaaaccggagtccggctccggtttttgttgtcatgtccggtggatgtttgttatgactccctgtgtttggaatgaatatttaataacaggtgtctggaaatataggggcaaatctactggataggctattggggcgtgagaatcgaatggagagaagggctgtggctctggaaaggcaattaaatggaggtgtcgattttttaaggagtgttaataactattttcagagtgtcatggcagaacacagagaaaataaaacaagtaataaaatattaatggaaaaaataaattcctgtgtatttggaacggattctaatcacttttcttgcccggagtcatttttgacatgcccgataacgctggacacacctgcgaatggagtgttcatgagaaactcacaaggtgctgagatatgctctctatatgataaggacacgttagtgcaacttgttgaaactggtggagctcatcctctgagtcgagaacctataacagaatcaatgattatgagaaaagacgaatgtcactttgattcaaaaaaagaatcctttgttgcaagtgatgcttaattttttttgttggtgtgtttttatattaatagtttattataatagtgccatgtaaggatatattgtctgaacaattattcagacaatatttttttcttgctttatatgaaatatataatatttggatccttaatttctaaccaaggggtcccatgtttttatgttatgatgcagcccataatttcgggggctacatgcaagaatatctttttcttcggcgcctgatttgcgtaaaaacgtggctgcgccagaagaacaattaccttgtgtttctgtgaatggcggtaacattttgtaagtcggtatgttgttgagcattgtttttatattgtcagctggaattgatttttcttcatgtagtggtgtcgggataagcgttccatttctctgaagtacttcatctgaatataatcgatgtagcaacaaactctgttttgtctctattaatgagattgagttgatattgggtaagtaacgaattgataactgactgagttttattacatttcctgaataaagatactcacctaactctgaaaatttccttcctgttatcttatctgtatcatcaggactaatattttcgaacattcttacgtctcgctctcctaagtttggttttgcattatcttttccattgtttttatatatccacatctcttttttttctgaaggaatcaaatatgtaagtgattttacttcatctgcaatttgttcttgttggatattggtattggcctttaacctggtttcattatactttttatgaaaatcttcaatgcatgtgaatttttgcccttgtagttttataaccgtttcttttacatcgattggaaatttattttgatttcgcgcattatttaacttttttaaaaataaagagtcaatgtctattcgggagcgtttatcatcactgtttat

SEQ ID NO: 255 - DNA  (genomic), 4229 bp; double-stranded, linear
ctcatttttcagcaaaatattctgcttatctgtcgattccccagcacgccagcgcgctctcctggtcacgacgggatacctgaccgtaacagttgtttgaacgaatacggcagtctctgccaccgtccttaatccaccagcgaatcgcttcgcaggcaccttttcgatctcctgcattaattcgtctgtaaaacgtcgacgggaaacacttaccgggaccaatgttgtacggacagaatgacgcgatccccgctttctggggttcggtcagcggcactctgatgtttttctccacccatgccagcgccttatcacgctcaatggcgttaacccggtcgcatttttccttcgacagcttcatgccaggaataacaggcttaccatccccccgggtggctccacggcagatggtccagatacccgcaccatcacggtatgctgtggtgtggttaccttccttttcatccagaaactggtcgaggatttcaggcgcagacgcccctgcaccaatcagcgccagaacggcagccgacaggccgtatctgatttttgcgttcatggatatttatcagggtttatcgatttcaaatccctggatatgttaagtcttcaggccagcggtggagtcttcagagaacccgtaattattcccggtagttttcctctgtaggttatcaacacatcctgcgcctctaaaattacggggcgcttttccggcaacggaccatccccttcacataacccggcagcaacatccatgaaaaactgcttcgcctgctttttcgcctcagcttngtaaaactccagcgtggcaccttcagtacggtcaagactaatcgccacatntggcaacaacagtgacggatacccaccaatttccggtgccacagtaacagtaatnttatccgggtaattatttatccctttaacaaccagttcgtattttttcttcatcactttactctccccgcgccgccttacgccggtcttctttaatcttgaaatacaggttcgtcagatatgtcagcagcccaaacagcagactccccagcacgcctatcgccacccactgggacggagagactttgtccagcagctgcagtaaccagtatcccgtccccaccgctgacgtggtgtatgacacacccgttgtgattttttccatctgatgtatgtctccgtcaccgccaacagaaaatgaaagtaaaggaaaacaaaaaagccgccagtgtcacccactgacggccaacgccgggagccgtgattatggcattcaggctctgctaaaaatgccagataacattccggcctcccccgattcaggttataaatgacacaatatcttgacaacatccgtcactgtctgtcagaaaatgtactgccatatagaagcaacatgtgaagtacatctatccttttgagccagcacctctccaccgaaagtcagtgctggctgtttttttccttaataaagcatctgtaactgaaacaatccgcatattgataatatattgacaggcatcattgctgtctgtgaaaaataagtctctacaaacatataaggccttttagccagcgtcttctttttcaggtcagtcgctggctttttttattatgctgccggtgcatttatctccagcatcagactttctatctcaacgccatacgctgcattttttgtaacatccgtcagcgtcagcgcattcagtcccagtgtcagactgtcttttataacctggaatgccgggccagccactccattcagtttcggagtaaccgtggcactgccggcggtgaacaccagctccagcgtctgccagtcgttaccgtaatcgccgaactcccccagcttcgtgtttccggctttcctgtgatgcatcagattcactctgccgtcagtggtctgagtgaagtacgacatcaggaacggattaccggtacccgtcatcgccacaccatcaggaacgggagcgtccgtatacagataaatccccagcccgaactgattgttggtcagtgcgcctgacaggcggaacttacaggtcagtctgccgccctgtgtcagcagggtaattgcgtcatccaccggatgcgtcagggaccaggttttattgctctgcctggtgatcttaaatacaccatctgacaactgaattccgccatccttaatgctccagccctgcgcagcagcctctccggctgccggcagcagggagattgtgcgaacggacgtatctgcagacggacccgatggcgtgttgccgccgggcgagggtttgatttccggtgccttaccactgatgaaggctgaggtgcgcccggctgcgttcagaatagcggttgccagacgatccggaataatgctcctgcgcgcccatgaactgaaatgtgtcgggcggtttgatgatacctggtttccattcgttctcgatgccgcaccgtaatatcctgatgccggaatatccggatcttctgccggcgcgttagtggcggtattgacgccgttaccgtctgtcatgaagggcacaaaataaacgccctcactctccctgtttttatacccgccgtacacggtgtcgtactgggtagcgtatgtatttttccagtaatacgtcgtgtcaccacaaatccacggcacatctgcagcactgccaccatggcactgcgcgttaaacacggagaggtcagcacgaaactgtgtcagcatggctgtaaacagcgcaggttgctgtgcgtgggtggcggcgctcatgtcaaactctccntgcatccagcacaccgccagcaacacatttttcgggttcttctgtaatgcagctttggtgcgcgcaatcaggtcctgatataacggtttacccacaccccagcgcgccgaatcctggctggcccccgtggactcgctgaatatcccctccgcgccctgggtaaatgccgaaccaccacgacagcatggtaccagcaggatccccgcgttattcgggatatacgggagcagttttttggcaatatgtaacccctggccgacacagccgtactgccctttgctcaggtctgccttcggatgattcagcgtactcatatcctgcacatcatgcaggcagtggtcggccggaataatatcgttatatctgcaggcagccccacccggcgtcactgtactgcggcgcgccagctgtttaatgcgcggatccggagcatcgtatgaatccggcagcggaagcccttcaccgtaagccatggcattggactgcccggccagtacgatgacgtagtaccaatccggctcagttgcaccactgaccaccacatcaccttctgctgtaatcgcctgcatcagggtataaggggttatggccaccggactaccaaacggctgccagccctctttcagtttgtgtgtcagcttttccgcaaggtctgacggcgacgccgccctgacaacatcataatgtttaatcgacatcgaatttctcccgtgtacaggaacagagttaaaaagccggaaccggaatcaaatcacaggatgaccatctgccagtggctggtcgtaaaaaaaagccgcgccatgcgcagccggaaataaagggataacgatgatagtttgagaaaaacagaaacaacacttttgtggcaaagcatggtgccgggtgcctcccggtgaattcagtatcagcacctgaatccgcgattatcccatatacctggttgctgatcgcccctccgcacagggggattcaccatgcagaagtgtttttaataaacagcaaacaaaaaaatcaagcattatgcaggctgtttctttttatcaccggccacagcaataccacaatgccgcagaccagcaccccatccgccagcaccgacatgattctgctggtgaaatccaccatcaccaccagaaacagcaggagtgcagccacagccaggcgcagtttaccgtcacaggtgattctccagacgaagacccagaacaccggcaatctcttccagcaccttgcgctcttccggctcaatttcgccgtctgcctccgcaatggccaccgccacatccagcacatcttccgcttcacgcgtatcgtgtttcacatcctcaatctcacgtaacgccgcacgacgaccagttttaaagttcgtatccagctgaccgataatggttgcgctaatcgcattaatttctgacgtaaacgcggacagcgcaggctgattacgcagtacctgttcgatcttcg

SEQ ID NO: 256 - DNA (genomic), 9510 bp; double-stranded, linear
atgattcatcctggctcttctttagataaagcaattaacaatacaagagttaaaaatgttagtactgatgttaaacatggccaaattcaagagagaaaaaggaactttatctataaaaaaaatgatgatatctcatccagatttaaactttacagttcgctcgtaaagcagaaaaatgcgacagaagatgttgttttaataggcaaaatgattttagatgaagttagaagttacagaactatacataatgatcgaaatatcgtaagtaactcaggaaactggaaaacatcttttttatgtaatcttgctagactactatatagcatatttaatggtagtaactatttttgttcccgagagggtgaaaataattcatcccccagttctactctacttactatacatcagcctgaaaagcaggaactattacaacaaaagagtatcaaacatttaccaacaagtaataacatcgacggatacattaaaataagaaaaacaagaggcgctgaagatcaaacaacaactatcactcaaagtttgataattaatgagttgttaaatggagttgatagaaataccatcccttttcagaaaataagtgagctcaatgatatcatacattcatatgaaaatatgcaaattaaaaatagtcgaaaaggtatagaaatacttgttaagcagggagagctgttatcatcattaataaatgataataaaggaaataaacaattatcagacaatgcatctaaaataataaacttattgggtatagagtatcagtcacataaagtagacatagagccatttatacatgcagtatgggttgctggcgcacctcctgataatacattttcatatataacggcatttttaaatacatataaagattatacctacctgctctggattgatcctaatgcctttggtgcggccaagtttagtgggattttaaaaaatatagcgatgaattatgcaattatgcgtttgagaagaacgaatccacatttagcggaagaaatgaatgaagtgatattaaaaatacaaaacatacaaaatgaaactatagaatttaaggaaacaagagaaagattgaaggaacttgaaaatagatataaatcattaacgagtgaaactaaagaaaaattcaatgttttttttcttgagtcaatgataggtatgcaagacaactattttacatattgtatatcaaatggaatatcaaatactgatgatatatccagacttgactttttaactaacgttttaaaactttcaccagaagttcaaaatgactttaaatctacagtagagaaaaacaaaagagatatagacttattaaaaaatacaatatctcaaaaatttggggatagatttcaactgagagatattaacacattggagtcatttaaaaaaccacaagattattttttttatcaacaagagatgctattaagatggaactacgccgctgcatcagatcaggtaagaattaatatattgaaagagtatggagggatttataccgatacagatattcttcctgcatattcagataaagtatcacagataataaatgaaaaaagtgatgataagaggttttttgaagatttaaaactaagaaggattatatcagaatctattctgtctctgataaaaggggaaaagtactcaattaaacatgatggattagatgaaacaacactaaatcagttaaataacatattgagtgaaatagaaaaactgacgatagatgattattttaaacccgttgagacaaaagttgtcagagatacatttaaaatttttaaaagatatcaaaaatggacagaaaacacctggaatattagagggaataataatttcatgttaactcacaagggaagtaaatgtattgattttattctatcaggacagaaaaaacagtatttagaactccaacgcatcagagataatataagttataataatctattttatactacagaggatctaaagtctttaaataatgtggcaataggaggaatacctgcaaagaaatatttagaacacggtttgttttctgaatatagacaggacggtacaattccttatgtggttagcactttaaatatatctggcccagacatgattatgcgacaaatgaaaaaatactataaatctcttgggcgcataggtgaagtgcatattaaagataataaattgagtgatgttaattttttgggtgtatatgcaagttcaaataaagacaataaaagttttaactggctaaatccagtgagtgttggtattaatgatattacaccagatgatgaaagctcatgggctgtcagaaataatgatataaataaaattctattcgaaaaaataaactgccatgtacccgaaaaactacctacctccctatactatgaaatcgattcgcggtctttttttcaggggtgggataataaaagcataaagcatgttacagagattaataaagacctcatcaaagatattaatttattattaacatcgtctaatattgatgttaaacttttaataaaactggatcgtgaattatatgcgattagcagtaaaatagataatccgttggccttgcgctctataagaaccttacagctacaattagctaattacgtaacttcgaatacatttgaacctgaaaacacaattaattttatttatgatttttatagaaaaaaacaagatgacttactcagcgcaataaaattattttcgcgtaatgatgccgatacaaaaattattgtctggtacaattccgtaatggaaaaaaatgtgtttctccgagaggttatatcatgtgttctacgaagtaaaaaagtagatagttatataaatgaaaacaaaaaaaacttatctaaggaggatgccggagctttaagagattatgcaaaattaaaaatgaaagaactattttcgatgttagatgatgatggttataaaaaaatcataactacaaatgcatatattaaagagagggataaactatcaggcattatatacaacatcgaaaattcgattatatcgggtcatgaatcatttgatataatacgaagcaatcaacatgagtggggggatttatcaacggtagagcaatttaaaaaatttgagttttatgtgaaaagtgaattatcttcggctaagtcaattttcgatgatataaaaaacaaatatataacagatcctgaaacaaaacgaaacgtactctaccatcagttagatagtgatattaaagagcgaatagcatttctcgatatatcccactatgcatatccgggtagtttattagaaaaattacaattaagtggctacgttttttctgatatcaacataattgcagaatacttattggctagttacggagtttctggacattattctcacggcgtggtatatccagctccatctgataaattacttgagctattaagaagacatacaaagagcaattctgagtggatagaaaaaataaccccatatgtttatgatatattatccgataatgtatccaacgtcttgcgcccccctttatcagaagaacagaaaaaaatattgaatgatataaaattagaaattagtaaatctgtatcagaacagtatttcatgaagttgacagagcaaaaatcatcagttattggtattaaatattctgttgattttgacagatacaatgagaatttgtttttgtctttacctataaatcaaaatttaacgctgccttttatgtatcgctacttcgagatgctatatgacattcacattggaataatagaaaacaaggcaaacagggagtttatatatagtaagttttcatctttaaacctggattttttgattaatgacgagagagttttgaatcttgaaggtttaataaaaaaatataaatatttatcgctgagtgaaatacatagaactttaacaaatagtacttcatttgcagatatttctataccattattgcagaccatatgtcccagcataacaacaataataaaaaaaacagaatattatgggcatcagttaacaaatgctatgactgttgcttcagtggttaaaccatatgactttagcaatcttggtgccataaatagtatagataaatccgtttctgatgtgcctgcattgcatacaattgttgaacaagcaaaatataatttactttcatggaatgatttttataacactcatgcgtcaatatgggatacaatagcaagacagcataaaagtacaaatatcgaatttcacccacaaagtcttctttttgatagagattcgaaaggaaagtgccttggtttatctcttctgtatcttgatacaggggggtacggaggcggatatcaaaaactgaggcacaatattgacactgccagcacattatatcaaacaaaatacaatgacaatctaaaattatctaaccgtgatgatttctttttaagaaaaacacagcgtatcattacaatgtccaatgagttaggtaataacaggttaaaaaatgcacagttagaggttctggaattgaaagaccctatactaactgaaggcatattataccagcgtcgtatatcatctcttttaataacaacagaatatcattcacttgcattacaacaaatatcttctttttggagagtaactgatcctaattttggtcattgtgactttcattccttagcacaggctttaacgtttataaaaaatataacgagcaatcgtaacttttcatctttatatggaagtggcattgttaaaatttacttcagtgaatctcttaataattggaagtatattaagctcccccttgttcagactggttctttgttaagagacatatatttaacaaccccagaaaaattatccacaagcgggggttcattaaatattatggggcatctcgtgcctgtcagttttatttatgatatcggaggggttattaatggtaacagaataagtgaaagtacagatgtgaaaaataaaattaggagcttaaaaataaatggggatattttacaacattatataaatacgcattatttgtcagaggagcaaactcagaagataaaagatattgtggattttttaggtattcaggataacacaataaaagttaagcttgaaagtgatattaaacctataagtgaaatccaacagccccttcattccattctttcacggcagaaagaacacgtaaagaatttactatctggattgcttgatgagttttcaaataagttaagaaagcaaggtctttcacttaaaacaaatgttctttcagttaataacttcaaagaatcaaagataaatagtgatacagtggaggttacagtaacagatctgcaaggaagactttatcgtgttgatatagatacaagagttattggcttaacttttaaagaggggataaatagtttatccgaagcactcgaacacatgaatatcgatgcgattatgtctgttattggcttggttcaatatgcacgaatgataaaaatgaatgacaatattagtgcaatagatcatgcaggagcagtatcagatataaaaaatattgtagacaaatttttaggcggaattttgactcttactaataatcgcgtatataatcctggcggtgtatctggtgcctcgcttgaaggatttatatcttctgggttggaggtgtgtgcttcaagaatgggtggcaccgcagggcgttatcttagcaatgtggcaaaagtaattaaattacctttgctagatataggcataaatatttggtcattatatgattcttcattaaatcatgctaaagccaccacacaaattgaatatatatcaacagcaatagatgtatctttttcatctataaatacagctttgtcaataggcgcaatcgcatatcctcctttggcaatagctatagttccgataactattttttctcatgaagtaaaaaactatgctgtttatgtgaatcaaattaatgagcgccataagttatggctcgaagctgaaaagtatctggacaatggaagtgcaaaggttctaagcattaacaaagccacaggcataatcgatttatcaaataatcaggtgttaggtaatatttatttagatatgagagaaaatcctccaatattacacggtgagaaatcatataatagcggaaagaatattggtagtcatcctgatatgactgacagagagattatggagtctagagcatacaattttgcatgcacaaaactctcagatgcaggtgaacccgatattttcggttggggagataaggaaatatgtaattcaatggaattatcagaatcacaattagctaatgggtattctaaccgccaatggccttctcagattccagttattccagaaggaatttataatacagtatatcttggatatggagaaacattgcgagctaatactgaagttacattgagtagcactggttacttttacgagattgcaagggcatatactgatgatgaactatctgagccattattaacagtatgtaaccaacatagtcatgttattggtggaaaagaaccattaacaattattattcccgctattgaacatggtatgcttggctctaatctacatatgattgaacgttttaaaaactataatttctcgatatcaggagggaagggagggataaaattaatggttggtggtattggtgattacaacatagaatgtacccccggtgttagaaatattatatcgtttgaacaattatcacgtgacttcaatctggatttggatttatcagatgggaggaaacaaaattttaattttcatcatccctcaggtttttattcaggaaaagttatgagcataacgcaaaagggtataaatgcggttgttggtactaaactgggatatgataagattcgtggtaataatcttgataataccttttctcttgggagtggaggaggtgttatatattctggaggagggagcaatacctatttcgttcccgccacactacaggataatttacacatatatatatcagaaaaatcaaatggcaatcatattatattaggtgatatgcactctcgcctatctattgaatgccactttagtaataatgaaagagagtttataaagatgggctactataatggatgtgatgtgattttagaaagtgacactatacaaaaaataaaatcatttgcaaaaaatataacaatacagacagcggatggagttatggcaaattgggatgataaactaaatactctgtctgtttattcaatagatatgattgcatggagggataaaaataaaactgcaaaagaaccgttaccagttgatgtaatccagttaactaattggaggatgcataacacatgctctttattttatgataaatatcaagttgatattgaagccaataagttaacgtatacagtcttatttcctgatacggagttacccgttcagctcaattataccagtattatttatggtaatcatggggcaaaatacaccttcctcaattcaggaagtaaaactatagatattcacattcttgataaaaatagtgattatgatacttttgacttccgtaatattatttttgaacattacaccaatgagatatttataagttttgataatcaaggaggatttgttatatcaatattaaataatgctacgagtgaagcggcgaacattaatgtattccgaaaaaacatgacttctttagatagtagtggttcattgatatatttgcctagcggtgatatttatcatatttcagatatctataaaatgtccagaggtagaaaatcgtttaaattaaatgtagaaaagaaacctgacattgatgatatcatcaatgtggctattttagaaacttcttatctacaaataaaaaaaatccccaataatgatgatagtgattatattttatgtttagacaaccctaacctctcatcttacacattgaactttaatgacttgtctggatacatatcaagtttatgggataatattaggggtagttttaccccttttcataaaaatactgtaaacatcgcccctaatgaaaaaaaatatatttccctaatcggacttgataagttgtcattcaatattgatgtttttagacaagcattagaggtaaaaaataagaatagttacaagataagtaaatttacatgggaaacgtatggtgatatcgttgtatcacctgaagatagaatttctcatctggagttagatgggtttaattatttttcacaacccgagttagatactccaatatctgactcattttcatatttatatgataattttcagatcgttgatagtgatgtgcatattaagcttcttcatctcaacagagaaacaaagcaaataacaccacatcgtattattcttaaaagatactttatagactcatttgctaaaacaagtatcactgacagagaaaagaatatatatcctgtgatttgtgattcacctgatcacttcacaagcgacatatataggcatccatttagaatagttctcgggaataagacattgtatccatcagaagaacttgtaaaattcataagcacctcaaaagaatatttaagcaatatggatgtgattaacaatgttattgttcctcaaaaaacaacaaagaaaaacaaattatccatagttagtttaaatagcaatatcaaaaatgatattgtattgtccggagtaatgaccggaacatcaaagatttttcatctaaataattcaggtgatttattgttaacaacctcaaaaactcatggtggtggggttgtggttatttttaaagattttataaataactggtggaaatataatcttactttaataacagttcctattgataataaattgtcagacaatagaataaatataaccccaatggggataaagatacaggaaacagtcagtggaaatgacaggttgtttttttaccctactccattaaaaaatggatgttttatcttgcataatccactttactctaactcattcccttctttatattcacatgaattatttgatttgattgaagcatatagaaatccaacgtattcgtatttacagaacaatattatcaatagatatatacatactgtttctgagtatgctggaaaagacggtattgccaatatgtcattatctatatacgcatactcgacatgtcgtttctggtcaaaagaaagtgtggctgtaggagatacaataaaattgtctaattatgagcatattgagtttagctttaattcatttagtaaggattactttcgtgaacaaaatagtgatatatataaaatattttttaaaattgcttcttcgagtaattcggttgttgtggataaaaatacgctcactcaaaaaaacttcctagaaaacaatacatttttcagtattacaggtatagatgagtctctctatgaaaagcatataatctttatcactcttaaggttattgtcccctcaaaaaagtag

SEQ ID NO: 257 - protein, 3169 aa
MIHPGSSLDKAINNTRVKNVSTDVKHGQIQERKRNFIYKKNDDISSRFKLYSSLVKQKNATEDVVLIGKMILDEVRSYRTIHNDRNIVSNSGNWKTSFLCNLARLLYSIFNGSNYFCSREGENNSSPSSTLLTIHQPEKQELLQQKSIKHLPTSNNIDGYIKIRKTRGAEDQTTTITQSLIINELLNGVDRNTIPFQKISELNDIIHSYENMQIKNSRKGIEILVKQGELLSSLINDNKGNKQLSDNASKIINLLGIEYQSHKVDIEPFIHAVWVAGAPPDNTFSYITAFLNTYKDYTYLLWIDPNAFGAAKFSGILKNIAMNYAIMRLRRTNPHLAEEMNEVILKIQNIQNETIEFKETRERLKELENRYKSLTSETKEKFNVFFLESMIGMQDNYFTYCISNGISNTDDISRLDFLTNVLKLSPEVQNDFKSTVEKNKRDIDLLKNTISQKFGDRFQLRDINTLESFKKPQDYFFYQQEMLLRWNYAAASDQVRINILKEYGGIYTDTDILPAYSDKVSQIINEKSDDKRFFEDLKLRRIISESILSLIKGEKYSIKHDGLDETTLNQLNNILSEIEKLTIDDYFKPVETKVVRDTFKIFKRYQKWTENTWNIRGNNNFMLTHKGSKCIDFILSGQKKQYLELQRIRDNISYNNLFYTTEDLKSLNNVAIGGIPAKKYLEHGLFSEYRQDGTIPYVVSTLNISGPDMIMRQMKKYYKSLGRIGEVHIKDNKLSDVNFLGVYASSNKDNKSFNWLNPVSVGINDITPDDESSWAVRNNDINKILFEKINCHVPEKLPTSLYYEIDSRSFFQGWDNKSIKHVTEINKDLIKDINLLLTSSNIDVKLLIKLDRELYAISSKIDNPLALRSIRTLQLQLANYVTSNTFEPENTINFIYDFYRKKQDDLLSAIKLFSRNDADTKIIVWYNSVMEKNVFLREVISCVLRSKKVDSYINENKKNLSKEDAGALRDYAKLKMKELFSMLDDDGYKKIITTNAYIKERDKLSGIIYNIENSIISGHESFDIIRSNQHEWGDLSTVEQFKKFEFYVKSELSSAKSIFDDIKNKYITDPETKRNVLYHQLDSDIKERIAFLDISHYAYPGSLLEKLQLSGYVFSDINIIAEYLLASYGVSGHYSHGVVYPAPSDKLLELLRRHTKSNSEWIEKITPYVYDILSDNVSNVLRPPLSEEQKKILNDIKLEISKSVSEQYFMKLTEQKSSVIGIKYSVDFDRYNENLFLSLPINQNLTLPFMYRYFEMLYDIHIGIIENKANREFIYSKFSSLNLDFLINDERVLNLEGLIKKYKYLSLSEIHRTLTNSTSFADISIPLLQTICPSITTIIKKTEYYGHQLTNAMTVASVVKPYDFSNLGAINSIDKSVSDVPALHTIVEQAKYNLLSWNDFYNTHASIWDTIARQHKSTNIEFHPQSLLFDRDSKGKCLGLSLLYLDTGGYGGGYQKLRHNIDTASTLYQTKYNDNLKLSNRDDFFLRKTQRIITMSNELGNNRLKNAQLEVLELKDPILTEGILYQRRISSLLITTEYHSLALQQISSFWRVTDPNFGHCDFHSLAQALTFIKNITSNRNFSSLYGSGIVKIYFSESLNNWKYIKLPLVQTGSLLRDIYLTTPEKLSTSGGSLNIMGHLVPVSFIYDIGGVINGNRISESTDVKNKIRSLKINGDILQHYINTHYLSEEQTQKIKDIVDFLGIQDNTIKVKLESDIKPISEIQQPLHSILSRQKEHVKNLLSGLLDEFSNKLRKQGLSLKTNVLSVNNFKESKINSDTVEVTVTDLQGRLYRVDIDTRVIGLTFKEGINSLSEALEHMNIDAIMSVIGLVQYARMIKMNDNISAIDHAGAVSDIKNIVDKFLGGILTLTNNRVYNPGGVSGASLEGFISSGLEVCASRMGGTAGRYLSNVAKVIKLPLLDIGINIWSLYDSSLNHAKATTQIEYISTAIDVSFSSINTALSIGAIAYPPLAIAIVPITIFSHEVKNYAVYVNQINERHKLWLEAEKYLDNGSAKVLSINKATGIIDLSNNQVLGNIYLDMRENPPILHGEKSYNSGKNIGSHPDMTDREIMESRAYNFACTKLSDAGEPDIFGWGDKEICNSMELSESQLANGYSNRQWPSQIPVIPEGIYNTVYLGYGETLRANTEVTLSSTGYFYEIARAYTDDELSEPLLTVCNQHSHVIGGKEPLTIIIPAIEHGMLGSNLHMIERFKNYNFSISGGKGGIKLMVGGIGDYNIECTPGVRNIISFEQLSRDFNLDLDLSDGRKQNFNFHHPSGFYSGKVMSITQKGINAVVGTKLGYDKIRGNNLDNTFSLGSGGGVIYSGGGSNTYFVPATLQDNLHIYISEKSNGNHIILGDMHSRLSIECHFSNNEREFIKMGYYNGCDVILESDTIQKIKSFAKNITIQTADGVMANWDDKLNTLSVYSIDMIAWRDKNKTAKEPLPVDVIQLTNWRMHNTCSLFYDKYQVDIEANKLTYTVLFPDTELPVQLNYTSIIYGNHGAKYTFLNSGSKTIDIHILDKNSDYDTFDFRNIIFEHYTNEIFISFDNQGGFVISILNNATSEAANINVFRKNMTSLDSSGSLIYLPSGDIYHISDIYKMSRGRKSFKLNVEKKPDIDDIINVAILETSYLQIKKIPNNDDSDYILCLDNPNLSSYTLNFNDLSGYISSLWDNIRGSFTPFHKNTVNIAPNEKKYISLIGLDKLSFNIDVFRQALEVKNKNSYKISKFTWETYGDIVVSPEDRISHLELDGFNYFSQPELDTPISDSFSYLYDNFQIVDSDVHIKLLHLNRETKQITPHRIILKRYFIDSFAKTSITDREKNIYPVICDSPDHFTSDIYRHPFRIVLGNKTLYPSEELVKFISTSKEYLSNMDVINNVIVPQKTTKKNKLSIVSLNSNIKNDIVLSGVMTGTSKIFHLNNSGDLLLTTSKTHGGGVVVIFKDFINNWWKYNLTLITVPIDNKLSDNRINITPMGIKIQETVSGNDRLFFYPTPLKNGCFILHNPLYSNSFPSLYSHELFDLIEAYRNPTYSYLQNNIINRYIHTVSEYAGKDGIANMSLSIYAYSTCRFWSKESVAVGDTIKLSNYEHIEFSFNSFSKDYFREQNSDIYKIFFKIASSSNSVVVDKNTLTQKNFLENNTFFSITGIDESLYEKHIIFITLKVIVPSKK

SEQ ID NO: 258 - DNA (genomic), 8729 bp; single-stranded, linear
ctgatttataccaggtcaaacttcaacttcatcatcaaaactttatgtcaataaaggcgtttatagttactgattcttttattttacaacaccactaacatctttttaataaaaaatatgttcacaatagcatacacagaaattctctaaggtattatatcatcaggaaatattattattccattcatctctggaggccccccctcgatatgaaaaacgatatcacacagaagccctgccgtgtacagataaactgtttgcagaccagtcagtgactcaggagcgacgtccgcaacaaatgtatggactgtatcacagatgctctccccgtatgactgaagacaggcatgcatgaaaatactgtcgcttccccaagaaaaggggaaattatcatctgcatgacccgaccagtgctcagtcatgaacactctgtttcagtgagcagtttccgcattaatgaatctgtcatactgctattgtatcagcaagttatccccataacaccttgatatcattctgagccagatggcataatcacagcccattgtcggatctttctgcctgattctctggataatcccgacaatatgcattgcttttctggcgatgtatagccccgggagccggaacgcttcatgacgaaaacaaacattcgtattattcagacgaaaactcactggaaaggcatcatcttttatataacaaggaaatccggctctttactgtcgttttatctttatttatcaggggcgtaagattgctcagtaccgcgttaccacaaaataaaaaaggctggcaggccatgctggatctccgttttcagcgtctgcacgggaaaaccacgctcaccacccgtcatcatgtcggtctgctcactgttcagcgtcctttttatcccgaagaagaaacctgccacctctgtctgcttcatccacccggtggtatcgtcggcggtgacgaactcatcatcaacgcaataattgactctgattgccatacgctgatcaccatgcctggtgccagtaaattttaccgcagcagcggcgcgcaggcgcaccttcagcaaaacctgacgctgtgcaataacgcaacgctggagtggttgccacaggattcgattttttttcccggcgctcacgccacgttgcataccgtgtttcatctgtcgtcctccagtacactgctggcctgggatcttctgtgccttggacgtccggtcatcggagaaaccttcagccacggaacactcgctaaccgtctggagatatgggtcgacggttctccgctgttgattgagcgtctgcacgtggccaatggagaacttacctgcgttgcccggaaaccatgggtgggaacgatgctgttctacctggggaatgaaacgcaactggaagacatacgcgaaaaactcacaccactggaaaactacgccggagccacgctcaccgatggtctactgacagttcgctttttaagtgatgataatctgcgttgccagtaggtaatgcgtgatatctggcaatttatgcggccgcaactgactgacaaatcaccggtacttccccggatctggctgacttaagagaacgctatggaactgactccaagagaaaaagacaaactattactgtttaccgctgcactgctggcagagcgtcgtctggcccgcggcctgaaacttaactatcccgaatccgtggccctgattagcgcttttataatggagggcgctcgcgacggcaaaagcgtcgctgcgctgatggaagaaggacggcatgtcctgagtcgcgagcaggtcatggaaggcataccagaaatgatccccgatatccaggtcgaagccacctttccggacggctccaagctggttaccgtccataatccgataatctgaggtaacagatgatccctggagaatataaggttaaacctggctatatagagcttaacatcggccgggctacctgcagtattatcgttgaaaatcacggagaccgaccaattcaggtcggttcccattatcacttcgcggaggttaacccggcactgaagttcgatcgccagaaggcaagaggctatcgtctcaatatcgccgccggaactgcagtgcgcttcgaaccaggccaaaagcgtgaggttgaactggtggcgctgagcggtgcccgtatcgtgcacggtttccgcggagatataatgggtgagctggaggcaaatgatgagtaatatttcacgccaggcctatgctgacatgttcggccctaccaccggtgataaaattcgtctggcagacactgagctgtggatcgaggtcgaagatgatttaactacctacggcgaagaggtcaaattcggcggcggtaaagtaatccgcgacggtatgggacaggggcaaatgctctccgccggctgcgctgatctggtgctgaccaatgccctgatcatcgattactgggggatcgttaaagccgatatcggcgtcaaagatggaaggatatttgctatcggcaaagccggtaatcctgatatacaacccaacgtcactatcccaatcggcgtatccacggaaattattgccgcagaaggcaggatcgttaccgcaggtggcgtcgatacgcatattcactggatctgcccacagcaggctgaagaagcgctgacatccggcattaccaccatgatcggtggcggtactggcccgacagcgggttctaacgccacaacctgtaccccaggaccatggtacatttatcaaatgctgcaggctgcagacagcctgccggtcaatatcgggttgctgggtaaaggcaattgctccaatccggatgcgcttcgtgagcaggtcgcggccggggttatcggcctcaaaattcacgaagactggggagctacacctgcggtaatcaactgcgcactgactgtagccgacgaaatggacgttcaggttgcgctacacagtgatacgcttaacgaatcaggattcgttgaggatactctgactgccatcggcgggcgcactatccataccttccatacagaaggtgcaggtggtggtcatgctccggatattatcaccgcctgcgcgcaccccaatattctgccttcctcaaccaatccgacgctaccctataccgtcaacactattgatgagcatctggacatgctgatggtttgccatcatcttgacccggatatcgccgaggacgtagcctttgccgaatcgcgcattcgccaggaaaccattgccgcggaagacgtcctgcacgaccttggcgcgttctccctcacctcgtccgattcgcaggccatgggacgcgtcggagaagtattgttacgaacctggcaggtggcacaccggatgaaagttcagcgcggcccgttaccggaagaaagtggtgataacgacaacgtccgcgtgaagcgctatatcgctaaatacaccattaatccggcattaacccacggtattgctcatgaagtcggctcgattgaagtgggaaaactggcggatctggtgctctggtccccggcgttctttggcgtaaaaccggcgactatcgtcaaaggcggaatgatagccatggcgccgatgggtgatatcaacggctctatccccacaccgcagccggtgcactatcgcccaatgttcgctgcattgggcagtgcccgtcaccgctgtcgtgtgactttcctgtcgcaggcagcagcagcaaatggcgtcgctgaacagcttaacctgcacagcacaactgctgtggtaaaaggctgccgcacagtacaaaaagccgatatgcgccacaacagcctgttgcctgatataaccgtggattcacaaacctacgaagtgcgtatcaacggcgaactgataaccagtgaaccggcggacattctgccaatggcgcaacgttatttcctgttttaaggagcacaaatgctttatttgacccggcgggtggagaccccggctcagacaactgccagcgttaccctccctgttgacatgcgggtaaaaagccgtattaaagtcacccttaacgatggacgtcaggctggactgttgctgccacgcggtctgctgctgcgcgatggtgatattctcagtaacgaaaacggtgatgaattcattaaggtgatcgccgctgatgaagccgtttctgtagtgcgctgcgcagatccttttatgctcgcgaaagcctgctggcatctcggcaatcgccacgttccgctgcaaataatgcccggagagctgcgctaccatcacgatcacgtcctcgatgatatgctgcgccagtttgggctggatgttgattttgcacatcttccgtttgagccggaagccggcgcttacgccagcaagtcgcacgcccataatcacgatcaggagcacagccactgaatgccgactccggaaaaacgtctgcggctgatgcagcttgccagtaacagcctccctgttggaggctacagctggtcccagggactggagtgggcagtggaagcaggctgggtagaagatagcgccgcctttgaacactggcagcagttgcagatggaacagagtttttttgccgtcgacctgccactgcttgcccggctataccgggcctgtgaagcgggcgatcctgacagtgccgggcgctggaccgcttatctgctggcctgcagggaaacccgtgagctacgcgatgaagaacgtaaccgcggtgcagccttcaccagacttctggtcgactggcagcccgactgcccggccgaatggcgcaaactatgccagcaaagccagttaaccggtatggcatggctcggcgtacgctggcaaatatccgtttcagacctggccctgagccttggctacagctggattgaaagcgcagtgatggcgggcgtcaggctggtaccctacggccagctggctgcccagcagttaattatgcgcctgtgtgcccgctatgcggcgaacatggacagtgcccttgcaaccccggatcacgcaattggttcagcaacgccacttgcatctatcgcttccgcgcgacatgaaacccagtattcccgattattccgttcttaggagaaaataaaatgaacataatcaagcaaccgctgcgtgtcggcgtcggcggtccggtcggctcaggtaaaaccgcgcttctggaagccctctgcaaatccatgcgtgacacctggcaattagccgtagtcaccaacgacatctacaccagagaagatcaacgcattctcactgaggccggagcactggaagcggaacgcattgtcggtgtcgaaacggggggctgccctcatacagccattcgtgaagacgcatcaatgaatctggcagccgtggaagcactgagtgagaaatttggtaatctcgagctgatctttgtggaaagcggcggcgacaacctgagtgcgaccttcagccccgaactggcggaccttaccatatatgtcatagatgtggcagaaggagaaaagatcccgcgtaaaggcggtccggggatcaccaaatccgacttcctcgtgatcaataaaactgaccttgcaccatacgtgggcgcctccctcgaggtaatggagcgtgatactttacgtatgcgcggagaacgcccatgggggttcactaacctgaaaagtggtgaaggtctgcaaaacatcatcgcctttatcgaagagcagggcatgctgggtaagtaatcacaacatcctctgtatcagggccggcaggcggccccttgtttttatcagaaggaataacggaagttggcgttcaccgcgttatccacgttgtacttaccagatgccgatttttcaaactccagaccgaagcggatgttgtcgcgaatttccgcattcaggccaacattcatgagcatacgaccgtctttttcacccttgatgcgtttttcgccggatgcatcacgcagtacggtttcaccgttagccagcaggtcaaactgataaccgataccgtcgcgggcagtgaaagagataattgaaaggggtgttgcattgacagattgaatctacagctgctttttttaatatatctcgctcaaggcgagcttcatttaacgccttacgcagttgcagaatttcagattccagttcagccaccgtgcgggaaccaggagtaccgagcccttttctggcggcggtaacccattgtcctaaagtgccttcaggaagagataatcgggaagcgccttcactgatcgaaagttgattttcaagaaccgttctgacagcttcggctttgaactctttagagtaacgttgggtttttctgctcattattagctccttctgatgccattctatttcaggaaggagtgtccgttaaactcaggctacctcaggtttcactcatctgggtttttacttccagatttcgttttttgatcgctgtgcccatggctccacatcctgaaagagccagcgcagagctgaccagtgcaatcatcataacttttttggttttcatttaatgcccttcttatccgacaggtttatggaagacagagaaaccgcctttacggtatattttttcagcgggcttctcaagtatgttaaaggatacaggtaaaaacagcgggatcagatacgtcgggtaaacgtttatttcataagaagtttttaggtcagaataaaataatgggtgttgttatattatcagatgatgatttatgtgagcgcgttacggatattgcacatgaggttaaaggagagagcaagcctccgcaacggctcgcttcttatttaatggattttttcgggaagtccagtttataattatataacatattgtaatactgaaagagagtgaggttataagaacagacagttgaatctgaccgtctgaatatgtacctttatgcggaattttcacttaaagggggaaaactgttgtgaaaccgaatatccatccggaataccgtacagtagtatttcacgataccagtattgatgagtacttcaggatcggttcgacgatcaaaactgaccgggtaattgaactggatggtgtaacttacccatatgttacaattgacgtttcttctaagtcgcatccgttttatacaggtaaactgagaactgtcgcttcagaaggtaatgttgcacgctttacccagcgttttgggcgttttgttgatgcgaaaaaaggtggctgattttgccgccagggtgcgtttgacaatttaaaaacgcaccagacagagagatcctgcacctgaatataccgttagcccgtcccaccggggcgtgtgcagatgatctcgtcaccggaagattgcggacctctctgaaaaccagtacattacgcgcgggtgcctttcggctgacggctggaaggattacctgaaggccggatgtggaaaggccccgagtcaacttaaacgttaacccgaggccctgaccatctaccttcagcaagtggaaggttagcgcctctctgtaaaaggagcaagtgctatgccgcaaaaaacgatcattgtgggcatgttatgcctgaccatgttgctgaccgtctgggtgttacacgcatcaccgtgtgaattcagggtaagcttcatgtggtcggaaattgcggcgttcttgcagtgtaaaccgtaagaaaccgcagcggggacaacagtccccgctatccggttgccaaaggttcggtcgaaagtcgcacccttgcacacaaatcacaaagaaaaaacaaaagtccgcagtgtaaaaactgtgggcttttttattcgcatcccgaaagtgtggtaacagcgtgggggcaccaaaaaaagccccataaaatggggctgaagattctgtaaggaatttcacagcaatgagattcctgctttctccaaggatatacgtgtcttcaggctgaatcaatgggggcgtggctctgaatccacctgcgattaaaacttgcacaatgccgggagttgagttagaaaagtacagggcgcgatatccggcttattttgttgctgtgttttgcctcgtgctggatgtcgcgtccaccgtttttctgatgattcatatgaaatggtactttattgatttactgccattctgatttgcctttttatgttcattattgcggttgtcacttccagtttctggtgatgttttgataaaagtgaaagaataaaacgataattgcaggaaggtattgctaaaactatacatatcattatataaacaagatgaaaatgatatataccataagaccagaaaagaggttttttccagaatgatatggatgtgtattttagtgtgattgtttttgtcaggtatattgaacaaggaagggccaggccactgagtatcagaaataagtcaacttttatcgatgcttctgttggtgtgtcatatatcagatgcaatatggatattataatggggcacattccccacaggatatttttgaaatagaatttccggttcatatgtttatgctcttttgttttatctcgggaattgtctctttttttttattcctgaacattttcgttgtttaataaccatggggtattatgattatcctttatttttgatatgtaattgtcaatagtggatttcgtttcattattgtggttatagtaatcatgaagagtgcaaaacacatcatcttttattgtggcgattaatggggggtgggtgaggttaaaatataaagaacgattgcttagtgtcctgaaatgaattttttcgccaatgaccagatcggtgtttat

SEQ ID NO: 259 - DNA (genomic), 4162 bp; single-stranded, linear
gtacgggctatattaacggctttaccaataacggcggtggcaccttttccagcgctattcaggtcaccgtcggcaccctgacgtggtacggctcgattgtggcatttgataaagagggcgacggctttcgattctggattggtgacgctggcgggccggactccaacaccttcctgtggaacaacgcaggcacgctggtaggcaactccaccacgtcgaacagcggcggtagcgccacggtgggcggggcggtgacggggtatctttcgctcaacgaaggttctggcgtcgatctgaacaatgacggcaggatcgacctggttcagcacacctataacctgaacaactattacacgctgtcttcgctcatcaaccaggggaatgggacgtttgtctgggggcagaacaccaccaataccttcctgagcggggcgggcagtggcgctatgagcagcagcgtttccatgacctgggccgatttcgatggtgacggcgatatggatctcttcctgcccgccagccagggaagagctaactacggctcgctgttattcaacaccaacggcgtactgggttgcccggtggcggtgggcgcaacggcaaccacctacgccagccagtttagcctggcggtggactggaaccacgacggcctgatggatatcgcccgtatcgcccagaccgggcagtcgtatctttatactaacgtcagcaacgccagcaactggacgcaatcggccctcggcggcagccagagcggtaccaccagcggcgtggcggcaatggactacgactgggacggcgcggtggatgtgctggtgtccaaacagtcgggcagcgtgttcctgagccgcaacaccaacacggtgagctacggcacttcgctacacctgcgcatcaccgatcccaacggcattaacgtctattacggcaataccgtgaagctgtacaactcggcgggagtgctggtcgccacgcaaatcatcaacccgcagtcgggtatgggggttaacgacacctcggcgctggtcaacttctacgggctgaatgccggagaaacctacaacgcggtgctgatcaaatccaccggcaccaccgccagcaatatgaccagacggtcaacaccagctggggcggtttacaggccaccgatgccactcacgcttacgatctcagcgctgaagcgggtaccgcgagcaacaacggcaagttcgtcggcaccggctataacgacaccttcttcgccaccgcaggcaccgacacttacgacggttccggcggctgggtgtcagctccggcaccggaacgtggctggcgaacggcgggatggacgtggttgatttccggctttcgacggtgggcgtgacggctaacttaagcagcactgccgcgcaggccaccggttttaacacctcgacatttaccaatatcgaaggcatttccggctcgaattttaacgacattctgaccggcagcagcggcgataaccaactggaagggcgcggcggcaacgacacgctcaacatcggcaacggcggccacgacaccttgctctataaactgctcaacgccagcgacgccactggcggcaacggctcagacgtggtgaatggctttacggtagggacatgggaaggcaccgccgacaccgatcgcattgatattcgtgaactgttacagggcagcggctacaccggcaacggcaaagccagctacgtcaacggcgtggcaacgctggatgcgcaggccggaaacatcggtgactttgtcaaagtcacccagagcggcagcgacaccatcgtgcagatcgaccgcgacggcacgggcggcacttttgcgacaactaacgtggtcacgctgacgggcgtgcacaccgacctcgccaccttgctggcgaatcatcagttgatggtggtgtagataatgaaaaaaaatgcccagtccgtggaagcctggctggaggcgatgatcgccgtggcgcgctattatcggctcgatttttctcaggagaatgtgcgcgcgaccgtcaactgggagcgcgacagtaagcgggaggagttactcaccgacatggcgcggcagttagggatggggttgcggttggtggagttttccgccgattcgcttaacccctggcgtctgccgctgatcgcggtgtttgataatcagcagattggcgtgatcacccgtcgcgacaatcatgacaatatcagcgttcagttcagcggtgacaagggctggaaactacacttaacgtctcggatattgaagataaaatcgtcgaactggcgctgctgcgccctctcagcgccatccctgacgcgcgggtggatgactatattcgcccgtatcaggcgaactggttctggagtctttcgctaaaagactggcggcgctacggcgatattatgctggcgtcactggtggcgaacgtgctggcgctggcggcgatgattttctcgatgcaggtttacgatcgggtggttccggcgcaatcgtacccgacgctatgggtgcttttcgccggggtgatgatggcgatcctgtttgagttctgtatgcgcatggtgcgtacgcatctatctgatgtgatcggaaagcgggcagacctgcgtatttcggatcgcgtttttggtcatgcgctacggctgaaaaacaacgtgcgatcgaaatccaccggatcgtttatctcgcagatccgcgaactggaatcagtgcgggagcttattacgtccaccaccatcggcgcggtggcggacctgccattcttcctgctgtttgtctttattttgtggatgatcggcggctggctggtgctggtggttttgctggcgctgccgttgctggtgatccccggcctgctggtgcaacgcccgctggcgcggctggcgaacgaaggaatgcgcgagtcagcggtacgcaacgctacgctggtggaagccgtgcagtcgattgaagatattaaactgctgcgcgccgaacagcgttttcagaatcagtggaaccacaccaacgacgtggcctcgtccatcagcatgaagcaacgttttctcaccgggctgctgctcacctggacccaggaagtgcagtccatcgtctacgtggtggtgctgctggtgggctgctttatggtgatgaacggcgacatgaccaccggcgcgctggtcgggacgacgatcctggcttcgcgcaccattgcgccgctgtcgcagatatccggcgtgctctcgcgctggcagcaggcgaaagtagcacgtaacggccttgatgaactgatgaagcgcccggtggatcagccggaacacggcaaactggtgcataaagcggtgctgcacggtaattatcagttcagcaacgcggtgttttattacgacgaagaagagaagattgccgatgtagcgattggcaaactcaacattcaggctggtgagaaaatcgccattctcgggcgcaacggcgcgggtaaatcgacgctactgcaaatgctcgccggaatgcgtatcgcccagcaggggcaggtgttgctggataacatcagtatcgggcagcttgatccggcagatctgcggcgagacatggggctactcagccagaccgggcgactgttctttggttcgctgcgggaaaacctcaccatggggatgccggaagccagcgatgaagatatcgaacgcgcgttaaccctcagcggagcgctgccctttgtgcagaagcagaaaaacggcctcaactacatgattcaggaagggggatttggcctctctggtggtcagcggcaaacgctgctgctggcgcggctactcatctctcagccgaatatcgtcctgctcgacgaacccagcgcctcactggacgaaatggcagaagcgtatttaatcgaacaactgaaacagtggattgggcatcgcacgctgattatcgccactcaccgcacggcgatgctgcaactggtggataggataatcgtgatggatcaggggcggattgtgatggacggcgcgaaagaggccattttgcgtgaacagggcgagcccacagcgcgacgggtggtgttgcaggagaagaataaggggtctgcggcatgaacggacaactgcaatataaccgtggtctgactgaaccccgcctgccgcgttcggcgctggcggtacgcgttaccgcg

SEQ ID NO: 260 - DNA (genomic), 2398 bp; single-stranded, linear
tgcatctgccatcgctatcgcctccaaccacaggttaaaaccggtgacgtgatgatggtgtcagcgggagcgggaacttcaacggtgaatctgcggtgtctgtcggaacatcatttaatgccggaacgcatacggtacttaaagccggtatttctgcggatacacaatctgatttcggcgcaggtgtcggcgtgggatattcgttctaatatttcaatcctcaatataaataagagcaaggaagcttgccgggttcacctcttcattaatttgtacattatttaaggttaacaatgatgaatagctccattaaatcgttttccctgctggcggttatattactggctggctgtagttcacccacttcccgcatcgcagattgccaggcgcagggcgtcagtcatgacacctgttacctcgcagaacagcagcgtcaggcggctattttaagtgcatccgaggcacaggcatttaaaaatgcagaagccgcacaacacgcccaggcggcaaagaaagccatttataaaggatttggcatgacctttagaatgagcagtaaaaactttgcttatctcaatgattcattatgtgcaattgatgaagacaataaagatgccactgtttatcagtcaggtctatataacgtcattgtttatcatcacacaggaaaagtcgccttaatgaaagaaggccagtttgtgggttatttaaaatgaaggagcaaaggaaaatacccctgacgcatattatgattatcggtgcgtttatttttgccttcttgcaagtagtattattagcctccctggttcacgctgtgaatgttaacaacgaaatccaggaaggcttatttcagtcggggcgcattatggtagaaagtttgcagcatattctttcggtgcaaacggggattcactgattttcaccccgcccgatgatgacagcagccggagagattttcgataatcgggcagtcggcgctgtcatcaccggggcaggcattcgccagcgccagtagctggttgcgcatagattgcagttcttcgatatgccgttcaatctccgccaccttctccagcgtgcgacgtttgacgtcggcactgtgacgctgcgggtcgttaaacagattcaccagctcgccgctctcttccaggttaaagcccacctggcgcgcctggcgcagtaaggtcaattcgttgagatgctgctgcgtgtaggttcgataaccattttcgctgcgcatcggcggcgtcaccagccccttctcttcatagaagcgaatggctttgctggtcaggccggtaatttttgctacatcgctaatgttcatcgttcgcgcaacgcctcctgtgctttgttaaagggtttcaacagataatccagcacgctttttttgccggtgcggatatcgaccgtcgccaccataccggggaatatcggaaactgctgtttgcttttgttttccagatggttgctgaaagtgcgaatgtacacccgatagtaataaacatcgcgccgcacttcatcctgcacggtgtctggtgatatcaccgccacttctcccggcaggccgccgtagatggagtaatcgtaggcagttattttcaccagcgatttttgccccgggtggataaacgccacatcgcgcggggagatttttgcctcaatcagcagttgctcatccagcggcacgatggtcatcagtttaccaccgggggcgatgacgccgccaaccgtggtgacatcaatatcctgaacaatgcctcgcaccggcgcggtaaagttgagcctggtgagagagtcttcccgtccacggatcaccgaacgctgggtttccacttccgcattggcttttgctaactcttcgcgcgcctgaacgtagtattgcgtgcgcacgtcgctgagtttgttttccagttcattggcctggcgttgcaggcgcagtacttcgacgctgctcgctgccccctgttttaccagcggctgggtcatcgccagttcgcgattgaccaggctaatcccctgcgtcagcccggtggtggctttgttcaacccgtcgcggcgagtgttgtacaacgccgtttccgactcgataagttcggggaatttattcagttcgtcagggaagaccagcggtttattgctcacttccgcccgcagccgcgccgaggttgccagcgccgcgtacagccgcgacatcgcttcctggacgtcggattccgttttggtgcggttaagctgcgccagcggctggccctgttcgacaatatcgccaactttcacgtcgagatgatacagaattccgccttccagcgactgcaccacctgttcgcgcccggaaggttctaccgtgccgctgccggtggtgacttcatcaagctggaagtaccacgcccagccg

SEQ ID NO: 261 - DNA (genomic), 45325 bp; single-stranded, linear
ggatccagaacagtagaaagcatgcctcccgcggtcgccagcacaaaacgccaggattgcagcgagatacgctgagtcgggtcattggtgattacaccgcccaatgcgcagtaagggatattgacgacggtataaagtaaggtaagtagggtgtaagtaattgctgcatagatcattttgccgttcatactgagatctggcgtgctataggccagtacacagacgatcccaaatggcagtgcgccacacagtacccacggacgaaatttaccccagcgagagcgcgttcgatcggccaacaaccccatgcaaggatcggaaatcgcatccagtgcacgagcgaccaaaaacatggttccgacaaatccggcaggtatgccaaaattatcggtataaaagaacatcatatataacattacgttatcgaaaataatgtggctggcggcgcctcccatgccataaccaattttctctttaacggacaacacttcactcttcatctgcttttccttgatgctataggggtgctgagaccgataacgcattttgtaaaccatccctgtgagagcgaatattccgatatctggttattaatttatgattcttgttttatgtgatcgtggtagcgttaattccgctcatatatcattgtaaaatatgagttttatatgaattataatgctttcgtgataatacgctgcgtgtattaggcggaaaaaactgatctgggggatgtagaaactcaaggaagtagctataatgcgccccgcctccatgtagcaatcgaggcgcggaagatcgtcgtctccggtgaggcggctggacttcaaatccagttggggccgccagcggtcccgggcaggttcgactcctgtgatcttccgccagtttgcctctcctgaactctcccgacatcaacaaagccccttataatcccttatatatcaggttttctttgtatcctgaggtcaaacgactttaacccatatcaagttgtttgtgggggtgcattgggggtatcaggttggttactggcggaaattcccccaggaggatggattcatcaaaagctggaggatgtcatggcgctaaccgatgttaaagtgaaaaccgcgaagccaaaagaaaggccctataagctggctgatggcggaggtatgtatctgctgattaacgctaatggttccaaatactggcgtatgaagtaccgcttcgccggtaaagaaaagatgctgtctattggcgtataccccgatgtaacgcttgccgacgcacgtgagaaacgcagtgaagccaggaaaatacttgcggctggtggcgatccgggtgaggcaaaaaaagaagaaaaaatagcgctgcaaatgagtttgaaaaacactttcgaggccgttgctcgcgagtggcatcagacgaaagccgatcgctggtcactgcgctaccgcgatgaaataatcgacacctttgagaaagatatcttcccctacatcggcaagcgacctattgccgaaatcaagccgatggagctattggaagcactacgtaagatggagaaacgtggagcactggagaaaatgcgcaaggtccgccaacgttgtggtgaggtgtttcgctatgcaattgttactggtcgagccgactataaccctgctcccgatcttgccagtgctttagctacaccgaaaaaagtacattttccctttcttactgccaatgaacttccccacttccttactgatctggcgggttataccggaagtatcatcactaagacagctactcagatcattatgttaaccggtgtacgaacgcaagagttgcgtttcgcgcattgggaggatattgattttgaggcaaaattatgggagatcccggcagaagtaatgaagatgaaacggcctcatattgtgccgccctctgagcaggttattgcgctatttaagcaacttgaaccaatctcaaaacatcatcctctggtctttatcggtaggaacgatcctcgcaagccaattagtaaggagagcattaaccaggtcattgaattgctggggtataagggaagactcacagggcacggtttcaggcataccatgagcacaattctgcacgaacaaggctttaattctgcctggattgaaatgcagttggctcatgtggataaaaactccatcaggggtacctataaccacgcccagtatctcgatggtcgccgtgaaatgatgcaatggtacgctgactacattgattcactttctgagctggcctgatgaatgaaagttcggtgacacaaaaataatgaataaccatccagccccaacaggcggatggttgtagtggcacagtaaatttggccacctgattaaaggtgatatcctcaccacaacacaaaacaggtgacttaatgaacaagaaaaccaaacgtactttcacccctgaattcaggctggaatgtgcacagctaattgttgataagggctactcatatcgacaagccagtgaagcgatgaatgtcggttctaccacgcttgagagttgggtgcgccagctcaggcgagagcgtcaggggattgcgccctctgccacacctattactccagaccagcaacgtatccgcgaactggaaaagcaggttcgccgcctggaggaacacaatacgatattaaaaaaggctacaaccgcgctcttgatgtccgactcgctgaacggttcacgatagttgccagactgagtgacagccactcagttgtcagcctctgttctgctctggaaatacaccgcagcagttaccagtactggcgaaaacgacgcgatacggttaatccggcgcgagtcaggttgtgcagcgaaatacgccgggcgtggaaccaaagtaggggctctgcgggggcgcgcacgctggctgaaatgctgacccaaaacggcgtcccgatgagccgttaccgtgccgggcgtctgatgaaatatctgaacctgagcagttgtcagcccggaaaacatcagtacaaaaatgctcgtcaggaacatacctgcctgccgaatctgcttgagcgccagttcgctgtgcccgagccagatagggtatggtgcggagatattacgtatatctgggcaggaaatcgctggtgctatctggcggtcgtcatggatctttttgcccgcagggttatcggctggagcctgtcagcgaatgccgatactgccctgataagcagtgccctgcggatggcgtatgaggtgcgtggtcagccgcgggacgtcatgttccatagcgaccagggaagtcaatatacaggactgaaatatcaacaacttctctggcgttacaggataaagcaaagtgtcagccgacggggaaactgctgggataacagtccaatggaacgcttcttccgcagtctgaaaacagaatgggtgccaaccgatggctacacaggcaaagacgtggcccggcagcaaatcagcagttatattctgaattattacaatagcgtcaggcctcaccattataacggagggctgacgccggaagagtcagagaacagatatcatttttactgtaaaaccgtggccagtattacttgaccactacactggaactcatgctcaccagcggtgagctgaatccccgccatcagcataccgtcacgctgtatgcaaaagggctgacctgcaaagccgataccctcggcagtcgaggttacgtttatatggctgtttatccgacgcccgaaacgaaaaagtaaatcatcagaataaccttctgctccggcctggtgttttcaccacgccacttccccatttctcatctctgcatatcaggaaaaactttagtatgaaaacattacccgatacacacgtacgggaggcatcgcgctgcccgtctcccatcaccatctggcagacactgcttggccgtctgctggaccagcactacggcctcacgctgaatgacacaccgttcgctgatgaacgtgtgattgagcagcatattgaggcaggtatttcactgtgtgatgcggtgaactttctcgtggaaaaatacgtgctggtgcgtaccgaccagccgggattcagcgcctgtacccgctctcagttaataaacagcatcgatatcctccgggctcgcagggcgaccggcctgatgacccgcgacaattacagaacggtaaataacattaccctgggtaagcatccggaggcgaaatgatgaaactggccctgacactggaagccgacagcgttaacgtacaggcactgaatatggggcgaattgtcgttgacattgatggtgttaatctcgctgaactgattaacatggtctgcgataacggctactcccttcgtgttgttgatgaatctgaccggacctcagcagactgcacgccaccatttactgcccttaccggcatacgctgcagtaccgcacatatcacggaaacggacaacgcctggctgtactcgctgtcacaccagaccagtgacttcggtgaatcagaatggattcattttaccggtaacggctatctgttgcgtaccgatgcgtggtcgtacccggttctgcggcttaaacgcctgggtctgtcaaaaacgttccgtcgtctggtcgtcacactcatccggcgttatggtgtcagtctcattcatctggatgccagtgccggatgtctgccaggtttacccacttttaattggtaactaggaacaacatgacatcattaaccccggaagcagcactggatattctgattgcgtggctgcaggacaatatcgacagcgaatccggaattatcttcgacaacgatgaggataaaacggattcggcagcattgttgccctgtatcgaacaggtcagggaagatgtccgtaccctgcgccaactgcagcttctgcaacagaaccggtgagtctcactcaccatacttcattccactgacgccagcctgaacagggctggcgttttcgtttataaaccaaaaggaaaaccgataatgtcaggcatcataatctcccgtccggaagtggacaccgggcatacggacgttatctgctccaccagtatccgacacgttgtgacggtacggaatgcagcactgcaacaaaccgaaacgcttatccggcaactggcagaaatctcagtcctgacagcagcagacattggcggcaaaaccgccctggaccgggcgatgaaacaggattttcactgcggctgctggctgatggagaaacctgaaaccgcaatgaaagccatcacccgcaacctcgactgcgaaatctggcgtgacctgatgcaacgctccgggatgctgagtctgatggatgcacagggctaggatacatggtaccgctcactggagtacgataatattccggaaatcagcgaggcgaatatcatgaatgcattcaaacaactgcaccagagtaaggatgaagtgtttgagcgtggggtgatcaacgtcttcagagggccgaacggaattacaaaaccaattccccctgtaaattcggcagtaaaattatcgtcaacaacttggtgagatgggacagatggagatttcatcttatcagtggaatgcaggcagatcgcttagctgacctggaaagaatgttgcatctgctcagcggtaaaccgctccccaacaaccgagggaatatcaccattaatctggatgaccacctacagtccgttcagggtaaagagcgctatgaagacaagtaaatactttaagaagggcccgcacacatcacattcagaaagccagagctggttgacaggcttaatgatattattgccagacactacctaggaatgttaccttcacaaaaatctctaagaattgattcaattgtgtattttagcctcattccctcatgtaaagtcatttgggggttattatgggggtcaatcatttatccaacacgcattaatcatttaaaatcaatgcattaataatcatattcgactcctgtgatctccgccaaacttcctcttctgaactctcccgacgtcaacaaaagtaagcgtacagcctgaaccgtctggtcagaatctgacgaattagacaaagtggtgtccaccaaataagtagtgggaaccaaagtatcagatatgcagaaaaatgtgactcccggcaggcgaaaaggctgccctaattatcctcccgaatttaaacagcagctcgttgctgcctcctgtgaacccgggatatccatctcaaaacttgctcttgaaaatggcattaacgccaatctgttgttcaaatggcgacaacaatggcgcgagggaaagctgctattaccttcttcagagagcccccagctacttcctgtgactctcgatgcagctgccgaacagccagaatcgctcgcagaggacccggaaaccctcagtatcagctgtgaggtaacgttccggcacgggacgctccgcttcaatggcaatgtcagcgaaaagctcctgactctgctgatacaggaactgaagcgatgatcccgttaccttccgggaccaaaatttggctggttgccggtatcaccgatatgagaaatggcttcaacggcctggctgcgaaagtacaaacggcgctgaaagacgatcccatgtccggccatgttttcattttccggggccgcagcggcagtcaggttaaactgctgtggtccaccggtgacggactgtgcctcctgaccaaacggctggagcgtgggcgcttcgcctggccgtcagcccgtgatggcaaagtgttccttacgcaggcgcagctggcgatgctgctggaaggtatcgactggcgacagcctaagcggctgctgacctccctgaccatgctgtaaatctctttatcctggttgtcacagaataagcccggtaaaatacgggcttatgaacgacatctcttctgacgacatcttcctgctgaaacagcgcctggccgaacaggaagcgctgatccacgccctgcaggaaaagctgagcaaccgggagcgcgaaatagaccatctgcaggcgcagctggataaactccgccggatgaacttcggcagtcgttccgaaaaagtctcccgccgtatcgcacaaatggaagccgatctgaaccggcttcagaaagagagcgatacgctgactggtagggtgtatgacccggcagtacagcgtccgttgcgtcagacccgcacccgtaagccgttccctgaatcactaccccgtgacgaaaagcgactgttgcctgcggcgccgtgctgcccgaactgcggcggttcactgagctatctgggcgaggataccgccgaacagctggagttgatgcgtagcgccttccgggttatccggacggtacgggaaaaacatgcctgtactcagtgcgatgccatcgtgcaggcacctgcaccttcgcggcccatcgagcggggtatcgccggaccggggctgctggcccgcgtgctgacctcgaagtatgcagagcacaccccgctgtatcgccagtcagaaatatacggccggcaaggtgtggagctgaggcgttcactgctgtcgggctgggtggatgcatgctgccggctgctgtctccgctggaagaggcgcttcatggctatgtcatgactgacggcaaactccatgccgatgataccccggtccaggtactgctgccgggtaataagaagacgaagaccgggcggttgtgggcgtatgttcgtgatgaccgcaatgcagggtcagcgttggcacctgcagtgtggttcgcttacagcccggacagaaaaggcatccatccgcagactcatcttgcctgcttcagcggtgtgctgcaagcggatgcgtacgccgggttcaacgagctgtatcgcaatggtgggataacggaagctgcctgctgggctcatgcccgccgaaagatccacgatgtgcacgtccgcatcccgtcagcactgacggaagaagccctggagcagatcggtcagttgtacgccatagaggcggatataaggggaatgccggcagagcagcggcttgctgaacgtcagcgaaaaacgaaaccgttgttgaaatccctggaaagctggttgcgtgaaaagatgaagaccctgtcgcgacactcagagttggcgaaggcgttcgcgtacgcacttaaccagtggccggcactgacgtactatgcgaacgatggctgggtggaaatcgacaacaacatcgctgaaaatgccctgcgggcggtcagtctgggtcgtaaaaacttcctgttcttcggctctgatcatggtggtgagcggggagcgctactgtacagcctgatcgggacgtgcaaactgaatgacgtggatccagaaagctaccttcgccatgtgcttggcgtcatagcagactggccggtcaaccgggtcagcgaactgcttccgtggcgcatagcactgccagctgaataacacatccccgtcaatacggccctcgctgtacgcttaccaacaaaaccccttttaatcccttatatatcaggctttctttgtgtacaggggtcaaccgactcaacctgtatcaagttgcttttgaggatactttagggggtattatttcctcttgaaatattagcaccccataatgggaaaaaggtaatacataacaatggtttttaacagtatctttgttatacaagggggcattgaggatatcaggaaaaatctcaaaatcggtacggacaggaaactacgtgggcagcaaaaacgtatggtaacaccgggaaatgcaacgcccaccagtcgggctaatccaccactccaatcgtggttcgcagtactgcacacacgattaccgggctatacaggagcggtttggtctgaaaacatccatgccgcgtaaaggtaaccgttacgacaacacctcaatgaaaaacttatagtaaacgctgaagaatgaaactatcgttttaataaccgggatgaagccatctaagtaatacggaaatacattgagattttctacaaccatcagcgccgccactcccgtctggggaatatctccctggtagccttcaagaaaaatataaccagataactgcgtaaaaaaagaacaaatggtggtgtccgctattgccagtatacctgagtttactgcctttcagattatcacaatcaatagcgaacagacttttaagctctgtgcgcttttaacaaaacgtccctttctccactttcaccgtataataatacattatttattacccctccaataaaaaccgatattactaatcacatttattaccacacaatttgatatcggtttttattagttggttaccctttcttcgattgctcataggcagctaaatgatcttttaatgcctgtgcaaggggcggtagtccactaggccctgtcggtggcggtggtgcctgacgggcgggcttaaaacctaaagcctcaggacctttcgatttttcataggcagccaagtgctcttttaatgcctgtgcaatgggcggtaaaggtcgggatgccccggatgcctgtccacttgtcggtggcggcggtgcctgacgggcgggcttaaaacctaaagcctcaggacctttcgatttttcataggcagccaagtgctcttttaatgcctgtgcaatgggcggtaaaggtcgggatgccccggatgcctgtccacttgtcggtggcggcggtgcctgacgggcgggcttaaaacctaaagcctcaggacctttcgatttttcataggcagccaagtgctcttttaatgcctgtgcaatgggcggtaaaggtcgggatgccccggatgcctgtccacttgtcggtggcggcggtgccggacgagagggagtaaatgaagtcacctggctgctcacattaaaaatcgttctcgcattaacattcgacgagcctggagaaaaaggggaatgaactttcaccggagtaagacgcacggcctgaggggctacagaaaatccagttccccccgcagagctcactcgacttgcgatacctacaagctgccgccctagtgtagaagcagcgttactaattccattaagcataatttatgcctctttatatctaagcttggctaactctcatatatatcaaaacgaataataaaatgatttttaaatcaatataaattaaaatcctcgtacccagccactaccattctcatggaccaaactgtacaataactgactcgtctcatcatccatacagtcctccaaagcctttaccgcatcattttttctatttaatccaaataagataataaattctaaatgtgcgatatcttttttatcaggtataatttgtgggaatacattcaggatagcttccgcatatttgggaagcttatggtttgccgcagctacagccgcccacaccagtatcttattagcagaaatatcattaaccattaaaattaaaaactacggttagaaatggttgagaccagatcttttatcgttttcaacattccactttctacgttaacataagcagaatattgctgaaccgcaaactgcaactctaacattttttcagggtcattaaccaaatcggtgctattaagtaactctggcacagaatcgctcagcgttttacctacttcacccatttgttgagtaatttcagataaattcattaaatttccctcagaagttaataaaataaaaacttttaactatttacgttcattacgaaccaaattccgtcttctgtttcttgctgcacggcaccctttctgatgaagtaattaaacaactcttcgcgcttttgacgttctgaatctgaaccaatcttagatttcatcgcgctgattttcttaatacccgaaaaatggtgatacaactcttcgagcaaatgagtcagcgataaaacagggccgttaagccctgtttggttacgtgcttcaaaagagcacaaaatcagttcttgttcatccagtctgtacgctaatgaaaaaaaaggtgtctcaatccgccatccgataaaaaaggcactgccacaaagaaactccttctgtattgtgtaccctttttgttcaagatagtaattaaacacttcatcattaaacgtatcgaccatgatcaattacccagctaagcgacccgattgccccatacgattctggacctcaaggagatcgcggacagcggacgttatatcacgcagacgagtcgtgatatcatcctgcgttctgcgaacgtcttgtttatacagctccagattcccctgctggaagttttccagcgacttcgcacgttgttcattaacctcatgagtcgatttgacggactcagatattgttgttggcaacgttttcgtaccttcagcaagactggtcacggcaacaaatgctgtggtattggtcagttcatctacggaattcaacaacttattgattctgcttgtcttctcggcggcgtctgcaagatcttcagcaaagtcagaggctttcgcaacatcatctgcaacgccagatgcacggctggctgctttcgttgttgtggccatcgctttctgcatcgcactggatgcctcctctgcgacatcagcaacactttccgtagccttgaccagagctttatttgcaacctcagaagccgcaccagcagcctttgaagatgcagagcttgctttttcagcaatctcaccagcccctttagccgcgttgttcattgctgcaaaagaacctaagatccccaatgctgatgaaataatcccgccaaccaaagcagcggttgccgcggcttttttttcctcaatagctttattctggctctcaaaaacggcctgctgaatctgatagctttgcgccaattgtttttgttggtaatcctgcaatagagtcaccatcttgccgaggagtttttgaatttccagcatcagcttacaaatatcaaccttaccatcagtaagcagagatgaatcaattgataaagcagatgcggcaactgcactggaagcgccggtcgtactctccgaagcggaattaaccatcgttacttgagtattatcaatagtattcataataaaattctctttaataattaaattcggccactaacaatacgactatttacccgtgctgaatcggacatcagttgagaaacactttgtaaatagctcgcctgattttgtaactcgcttgccgctttatccagctcgagcttcgcactctcacctaagctttcactctgtcgagttaagttttgcaccgcgaaagcagctaactgagacaacatttggagttgcgcagcctcattattcaacgcagttgtcccggcagaacgaataccgttcgtaacgccctcagccactgtcgaaatttttgcaaaaacgtttttaaccagcgcttctgccgccttctcaacgacttttacaacgcttgagccaattttgttagcaacattaccaaatttagataacagtgaagacaccccgccaacgccggctgtcagaatgcttgcggccatagatattccgccaaagacctgtgctgcagtctttaatccctgaggggcattttcccccattacatcgactgccgtttgcagtgccattgctgttgcaccaatggcaacaacagcccagagtgctgggttaaaaacagcggcaacggctgttaatgcgacgcccaaccaaccaaagacctggccaacaattttacttttttgtgatttctcttcggctttctgttgttcttcgagctgttttttatactcctgcgttttattctccagcgctttagtttgcccatccatataaatctcgttagagtttttcagactcgagactttctgcgcggaagtatccagggataacagagtgaccatcatcatcatttgctgagggtcaacggtattcacctgagagagatagggatagcttgtgcgctgtggctctgcctcctcagtgcgacttgtaacctcaccactaataccaccaaacaatttactaaggacatcctcagcagcagagggcgtcactaatgagtgacctgccggcggcgtcggtaaagggctactttctgtccagcctgctgacgagttcatggatttaaccagttgtaaatccagcgataaacccgtttcagattgagtaataccagaagtacccgaggcggtattaaccccagacgttacagacagggtatcgttatttacgttaagcatagttatctccggttatttaccaagggatattgctgaaatagttctatattgtagagattgcacatcagaacgtgcactcgttaagagatttaatgtattcgacatttgctgaatttcgagctggctattattcactaccgttgtcaggttattcgctttagctgaaatagccgccttcactgtttgcagatcaccagcgcttaaatcaccactaagatcacgaataccagttacacttatgtcattacgtggatcgtttatatagtcaatcacgtcttgaggaagtttggctttcgcattcttatcagtgctactctgaacatcagcaattttggcatccacaagattagccatcttttgtgccgtggttgacgctttagatgcctcattcatatcagcaaactttgcaatcgacagattactttgtgcctgatacatataagaaaacatgagaatcgcagcctgaaaaacaccgagttcctcaaatagcttaaccacctcatccttcgacatattacctaagtcatagatcgtcgatgtcgaagaactcgcactcacattaacaacggatgttgcatttgatgtatccatctatatacctcttgataatttttctcaggaaaacaaaaaaattattgagtaattaatatcaaataatttcctccttatagtcgataactttaccaatcattaataatgcattctctctctgctcactatcaataaagcaagcatctggtaatgatgtaaaaaagtctttcaataaatgaaaataataaatatgtttatcttcgacaatcgatacccgagaaggactctccagcaaccagtcttctgttagccagacatgttcaataatcgataacacttcatttaaaatgatatctttatctttcttaatagagatcgaaataatatctgcatagttatcaagtgataaaaaaatgattaccctgcataaatcactaataattgaagatgtctttactttgtcttcaaaagaagacatataagagagatcgaacgacagcgccctaataatgacttttaagtgcttctcacgctcgggaagatccttaatctccataaaccagtcaagtaaagaggcgccattttcagaatcctcatccttagccttttcataaagcttcttgatcttctggataccttcctgatttaactcacccacccctaaccaggaaagcagagccagctcccaatcatcttcgcctaataaatctaataataacctggcatatttcttttttaattcaatcttaacaaacttagattgcaataaagaagatattagcgcaacaatttccccctttggcatgttgccaaacatcgccaaagtaggatcgtgttgttccagcagcccgctgttttttaatgatagttcttttattttatcactatcggtaagagtaagcagctcttgcatatcattgagcagcttctcgattgtcgagccttcctcttctttccttgcgctacctttgcgatatcccaggcttagcccttcaatcgtttcagaaagcgatgaactagtaatcattgctaattcattttgcaaatttattaatggcgaagaaatattagaagaatttttttgcgttaattgctgagattctaattcaaaatctaatgaattagaattaaaaacagatgcggggttttgattaaattcaataccattagccattggaaactcacgtaatcattaattatgaatattccattaaatagtactgtacaacagcttcctttctactctattcttagacgatgtaagttcaccatattttttctcattgttcaaccaccaggatgaataaaatttaaaaatgttatcctcatataaaataaaacttctcaatggtgcgatgcgtaatcgggaattacaacttccgatgggaaacctaacgctaggtacggaagataacgatattgtttactttccccttgaacaaggcctcaatcagtttttacttgatatacgtgaggaaggtgttttccttttatctccggttgaattttggattgatgggcaacccacgccctatgaagcagataaaccattacctgtcggaaaggttattgatatagcgggatgttgcttcatcattggtgatattgaccattccttgccattgtctgatgtgccagaaaggttctctgccaaaagtcgacgcaaaaaacgccttatcctggcgagcgtgattggtgctacttttgcgttgtctggtgccatcggcagttacgttttgctttccccaaaagctgaacccccaacgtttaccagagctgatgtatatcagcagctaaaagaaaacaaacttcatgcaatcactctggtatggcatgggaaaaatatcgcgctttatgggcgttgcgaatcaaccacggatttaactccattttttaattacctaaaagaaaaaaatattttttattacaataatatcatttgcaataaccaaatcatatccgcaattaatgatgtcttaacggaatacggttacaaagatatcattattacaaaaggtaataagcctggattctttctgttatcgggatacattcccccttcacccaaatggagcgaggttgaaaatctgttactgaatacgccaggagttgcaggatgggaaatacacaacaacagtaacaataaaatcaatgaactggcatcagagtttaaaaagaataaactaataaactatgtcaatattttcaaaaagaatgatgtcatcattgttgcgggggaagtttctcaacagaatgagagtaagatccttgccattataaatgcaatgaacaaaaatagtaacgccaagatactctttcagaacattcagccgtacatttcagcagatattttccccggaaaaatactcagaatcagcggtacgatgaagaatccaacaattgctcttgataatggcaccagcctggggattggtagcattctgaaaggaggctatgtcatagacgcgattgatcctaaagatggtatcaacatctcccgcccagacgaatatatacatattccactgtcgtattaatttcttatcctcttccccctcttcggagggttttttattgtgtggatgttgtgagcatagttgttgcttgatgtgattcagctttggtatcagcgtggttggatcaacctacatgagaaaacgtgaatgtgtctctttgaaagagacctattaagcagataaaaagaccagtagtagatttgattataagaggttatttcttaagaagaaataattatgccccgactaaaacaatacatattttagccggggtggttatggaattattctacacaaaccgcatagacatttggagtattaacattaaccccaggaagagggttttgtgttattaggttataagtgcttgatactccagaacgctgctcactagatgtctgtttaatccaagcagttattgagttcatagaactataatggctatatttatttgcagccccccatgagtcataaatatctgacaataccgtctgtgtggatggtaataaatttttgcaaatggacatagcatcagcataataggcttgcttatccacttttatcatatacgacggtgcttttatagtgtaacttactgtttgcttatcaccagatgtggctttaattacgacactgcctttaccattcaaagtgactttccctgatgcatcgacagtcgcgatactggtattttctgaataccatgaatatgtaccatcaccaccgcttgctttcagtttaaactgaccatattgcagccaaatattaggcaactcgcctctgacattgttaccaataatatcaaccttgttgtcaattttcagttcatcaaaaaaagtgacctcagtcgctttaacctcagccccatcactgactgtcgcactaacagtcgctttaccggcggaactggaagttagtgttatcgtcgcacgaccatcatttcccgtggttgcttgcgtttgagacttaccgttgaacatcccaaagtttgttgagaatgtaacggattgattattaactggctgaccgtttttcataacttttacagtatatttaatagcatccttaccatttgctactgcagttgtcttatcagccttaatctcagtaatgctggccttggtttgatcaaaaaatataaccgcactggcattaagtgctgaagtcatctccgcggttttagcagacacgacgacctgtcctggcgtactcgacttcaacgttacggttgccttaccgttagcatccgttttggcactatttgccccaagagttgcagttcctgaaacaatattaaatgaaacagggacattagcctgagctaccccattctttttcaccgtcgcggtataagtaatggtatcggcgttatccgctttagccgaagtcttatccgccgtaaagtccgttaccccaacctggtcgacaacttgaccattcgacagaacggtaatagtaagctgtacattgttagagctattgccattacggtcataggcgcgagccgtcactttataaatattgctgccaccttgcacataagcaggcaaaatagcctggtagtcttgtgcgctttggcttccgctatgctgaatctgaccgccctgactgcgtaatgcactatcatcccagacgatacgatccagaccgtatttgctcttaacgatcaactgaatcttctgcgtactgtgttcagtaccattaatatcatgcggaatattcagagaaagaatatcctgcttcttgtactccagaataatattgttattacgctgaaccagatcgtaacggctgcctgataatgttcttaactcgttaacatactgtggttcaatttgctgagaccacgatttatcaaactgataacggaactgcattgagtaaaggagatcattttcattacccgtaccatgacggtaatcgatccccatcgtcaccagaggaatcggagtatagtttacaccaacggtcgccgcaccaggattcgactgcagcttatcagaattaaacaaagcaacattatcaccataatactgctcatatatcagcttggcgcctaatgccggatatgacggtagatagccattaaaacggatatcgaagccatttgctgggcgctcatcatagtctttcttattgtatgactcatgccagccgctcatgcggaaatagccgttaacgctacttttgaaatagtctcgccagtattcgccaccaatacctaaacgggtattatcaccagaaaaatcctgatcaatgaagacgttatagcccaacatgtttgcaggaaggaaaaaacgctgacccgcacctaaatttgccgtaaagcgggagtcaatgtaacgcgctccgacctgaccaaatgccagcattttttcggaatcatagaacggtaataagaagtccagtgaactaccgtcaaagttattaccactctgcagattaacctctgccgttccataatgttgtaaccaggcctgcaactgtgacgaagcctggttaccagcgataccaagagcggtatctttcgcgtaatcgccgttcagagatcgcgactgaagctggctaccgagactcgccgcctgttgtgccgcataatttaatgccttgtcatcggtcatgttgcttttggtcacgtccggggacattttagtcagtttattcgtgtgaccagcaacaccacctgcagcaacaagaggtgccgaacctaaaagtggtagtgcactgtattcaaagggaagttttttgagtggcaaaatgatctgctgaccaggcgcggccttcatcatttcgctttcagaactgtataaatgcttattcaacgaccaaatcgtcgataaattaatatcttgcgatttagaaagatcggcaacagtttcaccagttttcaacgtataaaaaaggcgattctgatagctatcatgagttaacagttttgaatccgaacccaatttaaaataattttcaccatttgcaaatgaattctgattaacataaaaaaacaatcctaaaccagcactaagcataatcaatgttttttttagcttatgcttgtgccgggtccgggtataacaaccatgagtaatcatgttatggctccaccacaatgagttagaatgagaaataaattatattaatagatcggattttatcttccggcgtaataatgtttattgtcgcttgaactgatttcctctattttcatatgttcgttttctaatgttattccctgattatgtaataccaaatacaggttttccattgacttaacaacgacttctatttcattctcgagtttttcaggggtagcatcatcgagagggaaacgtaacgctaacaacagcgattgtgctccagcctcatagcacagatatggcccaccattctctgcaaaccataagtttgcattcaaaatctcaagagcgaagttagagttatctgtcgggaatttcccacagacaccataaatcatcatatattcgtcattggcatcagataacgaaatataataaatttcatcaatagcaaaagaacacaatctgttttcattaaatgaaatagatccaataccaattttttctgcaaatttttctaataaaagttcagatcttgatgacattgtattttctcttaattaaatttatatttacagaagctcaagagttgcccatcctgcagcaatgttattccctgaaaaattgacgttagttagacttcccccctccctccctctaaataaaatgattatggatatatttagacgaaacgatgggatcccggcgctggtgggttattcgaagtattcacagcgctattactcccccccgttaatcctcccatgtcatggcgtaatccaccacttagcgccagacgcgcataagtgctttgaatccccgcacttggatttcctaataaccgtgcgccgttatcagtagtatcccggggaggatgttgaatggtgctatatacaacagaatctgtattccccatattctgaacagacgtattagaattagaagtcggcacctgcgaatcatgcagcgatgttttaacatcagcatacggattctgcacggtccctatgctggaagtgtcaaagaaagtcgacgaggtgctagccatcgagctacgtctgctctccatggtatcttctgacccaggggtatctacattgccctgtgcaggtgtattatttgcaggcttattctctaccgtacgtgcgcttgtagttgtagttgtagtagttgttgttgttgtttgttctaccggctgattttttcgatgaagcgcagcggtgacggcaacaccaattcccccaccaagaatcaatgcgccactaagaccgtagccagcccccgatgaaactttcagctcctcctggcgtttagcttgttgttcatcatattttttttgcgcctgagcattattttcaatggcttgctgtttggcctcttcgcctgctgctttagcctgctcttctatattcgcaacaacatcatctttcaatacccctgacggaatcgcatttccgagctcatcgatattaactttttgattatctgggttctggaacgcttctttcgttaactgatctcttgtcgcagtttcagttgcacttgcagctgcatcagggtcggtcgtggttgggctatccggctccggcgtcaatgcaagcgcctgtacaatacccgtcgccgccaaccctatcagacctgtagcaacagtccccaacgccaaccaaagtttaggatctgaacgaaggctggaagttgaggttgaggtctgagtttctgtggtgttttccgcaccgctatttgactccctcaactccccaacgccttttgactccccagcacctttggactccccggtccctttgggctctaacagctccagtatcctttggcgggcttccgtgatatctgaagcaacggtgaccatagcatgcccagcaccaccacggcctccagtaaatacaaatttgtctttaccttcaggatcaatggactgcaagcgagcgtactcttgatcacttaaaacaacagaggtctcaacaccattcctctgaccgacagcaatatgtttaccatcttcctgagtttcaactcgaaataccgaagagccaatctgcctgttaagagtatcgagcggaccatgatcatgaagaacttcaaatccatcattcagtgttatctcagacgccgccaggcgcatcggatttacaggaagtccaggaacatcactggcacgattgtcgccagaatcagccatagaattccttacaggcgtaaatagcgcacgagatcccaacggccccgtagagttaatgagctgaccacgcccccctgcaccgtcggtttgtgaaggtaatggaggtgcaggaggaattgaattattcacattgggattatgaccaagattaccaataggcataaatatctcctttttattttatgtaaatagataacaatcctttattttgctattacataataatgtatggtatacagcacgtagtcgataaacggctgaacatgacatcgaccaaataaatcacaatctgatttttgatgcaagaaaataatgtgctaaaaacacacatcgggtaacaaaataaaaataattatattatataaaagtaaacaccacgtgaaatcttaataaaacatttcataaataaaattgcagcaaacattcatttatattaaaaaacacagccaaagaaaaccaattaagcaaactataaatcttaattaataataaagtttattaagtttctttatcgcgttttttcttacatcaacaaaggccatgctatacaccaggaagcttaatttatacctgacaaggttatccctacaatcgggtatcctgtacatgctctaaaatcgcattctgagtaatcgcttttatctcactgactttgaagccgctaaagttgcgttcaaatatttcttgtgagacttgttctatcatcttcgtctgggtgttaaaacgtgttattggatccactcttttgccgcactgctcatcaactttctgattaaagtatttattggactgcaagaagtgaccaattgatgattgtgccccgttcatatcaagaggttgctgtaacgcattttcaacagctctaaaaatgtgacctttagtctccttactaatgaccgaattattactcctgcaatagtcatccagagttctatttactgttctggatatataagtcgtctgctcctgctggaaccattgttgggtatcgccattacgagtttgtttggctacagcctgcaggagttggttagtcagtttgccatgattaatcacaaagttcgactgcacgggcatgaacctcatacccgtggctcccgtacccgcttgcattgcagctctggtaaccgcaggtttaagcgtctgtgcagtcgcctgaactaacgatctgcctgccattgtcattggactaaacataccataaacctttataaattatatttcgacagtaaaaaaattgcttcccattaaaaaataactttaaagaataattatcttgtatttatatttgaattatcctccggccttatctacaggtagttgcactacatttatcatatgctatcatgaatatgcaacactattcccgtaatcttatatctacgccttattatttgtatcagaactctcggattaattacgtttgagtatatcaacatgaaaagaatggcaggactacaatatgaatgagaaatttcgcacagaccttgcacatacgtttgggatagctcttgaagagcaaactgacgtgctctctttccacgataacgatggccatgaatggatactggagtgtgcatctcaatctgaaattctgtttttttattgttatttattgaatagcgaatcaatacagattaattcaatacttgaaatgaatagcaatcgagaactgctcggtatgtttttcctgtcattaaaagatgacaacattcttttaaatattgcatttcctgcagataaaattgatattacagagtttgctaatttaatggaaaatggttatctattaaagaatgagataattagatccttgtcttccagacctacagattttttaccttgataatttctgcgctggatgggatcatccattccgtttaacatactcttcatcacagggacctctgatttctggccgctaacgtctctgaagattcagcctgtattatctaaaagcaatgtaatatcagttaaaaagcggaaaaactccagaattataactattctggagttaagtcaggaagaaaactcaaatgctaatcataatacgctataagaggaagctcttgttgctatagccctattatcaagacgttcggtagactgtacacgacgtaacaaagaagataatcctctttcagctaagatcccctccaggggagtacgaggaaaccaggttgaagaaagtggagttatatgtctctcatttaattttctttccaaagccttagtcacaccgccagaaaacacgctaaatagcgttgagaaacatccattttccggtgttattctttgtactttgtacacataatcatcttttgggccatctttaataaagtgaacagcatagtctttgcctctaaaagagacaatggtggaatcccctatttctggatatacccgatgatggcgttgttgcattcgggctttaagctgaatttcatctacgatatcttcattgggtatatgaagccttctgttgaacctgttccatgacgcatgttcacttgtcagaaatgtcttgaataccgctcctgataacgacatgatacatctccctatataacgtattcctgattaatcacatactatgctaacagtaaaataaaaatcttcgttgatttttacaatactcccgtatgctatcgtcgtattattgcgtattaactgacaaccaccaaaaagatggtatccatctgaattaataatgtcatcttttttaacattacgcaacatgtgtatatcaatatggactgtaccgatcgcacaataaatgcgattcatgacagtctcattgctaagagcagataacagatccgcagccagaacatccgtgacagataaattattatcactcagatttactgttgctaaaggggtattaataacaatccagcaccttctctcttgactatcatcaacatgatagagtctcagactatcaccaactctcaactctgtaactggataatcagtccacccaggtacgatatagccatcaaaaaaaagagcattagaatgtggaactaattgccaattatcattaatcagatattgtaaactttgtaccgttgtttcgagtataattacattaagtctgttttctccattattattttctattaccggataaatatctttatttagcatcgtaaattgaacatcatcaactgacacatcaccttccggtaaggcagtctgcattacccataagatcatgagttttatcgtatcttccggtatcagccggctttcgctatacgggaataactcttggcaccactgaatgaactgttcttctgatatccagaaacgcccctcatagcccgagtatgtcaacgtgaaacgaataccatgaccgctgacctcacgaaaatatgcatggcaagcatgacctttggacgtaatatagaggcgaccggttccgataactggcaacaacggcaaataaaaatcgttaattttcatattcaattgtgaactcaatggcttcatcaggaaagatttcttttaacttatcgaaaacatagtcttttttatgatataaaaaaacatgatttctattatttgggcttactttaatagacagataaatgattccgttactacatttaattgttaaaacaattcctcgtaatcttccacaaagaatactaaacgagtgctccccttcttcaaagtagcgtcgtcttcggcccgaggagtaaaacaatctcttccataaagaagccattcgtatgaacaacgtatcaggcgatcttttttttatatgataaaaaatatcattaaaactttcttctccttgcggccaatcatctgatggccgaaaagaaacaggctctatcaaatttctttttagagaaactctagtcaaagtaatgttcctttatggcaaaagataatttttctactgatttattaacatgttgcagattctcttttgttcgtttttgtgaatctagcaatgaacgcttttccttcgaaagtgaagattttttctcatacaatcgctgcttttgctcatcaaatgcattgtttttaatctgatatttatacaacgacactttatccaaattcaccagcgatgcacaatatgcctgcttagaggcaatcgactctttaatggattgctcgcagtcatcgagtttaccatccacctcttttatctgagagttaatcttagccattgattctctcaatcggttcgctctgcttttacgaatagataaaattctgtccaacatactcaggcaaccactttgaataggctttcaatcgttttttcgtaactactgatatctttggtgctttgttgtataaagttctgaattaatttcctattttttattgccttatctgcttcaggatcttgccccatcgtgtactcaccaatacgaataagcagctcaacatttttataagttgcaataagctttttgcattctgccgccgcacgcaaatgctccgatgtaacaacgttatgcataacacgactggcacttaaaccaatatcaattgcagggaaatggttttcctctgcaagttctcgggtaagtacgatgtgcccatcaagaatagagcggacttcatcgccaataggatcattaacattatcgctttctaacaacaccgtataaatcgcggttattgaaccttttggcgcaggccccgctcgctctaataatttgggtaacgaagaaaaaacactcggagggaatcccccccttacatcaggttctcccgatgcaagcccaacatcacgtgcggctcgggcataacgagttacagaatccatcattaataatacatttttaccttgatcgcggaagtactctgcaatagtcgtcgccgtaaatgcggctttcatcctttccagcgcggggcggtctgacgttgtgacgaccagtacacatttagaaagcgtggattgaggtaagagcgcgaggaattcatttacttcgcgaccacgttcgccgataagagcaaggacaataatatctgcggatgcgccattacaaatcatccccaaaagcgtacttttaccaacgcctgaaccagcaaaaataccgatacgctgcccaataccgcaagttagtagcccatcaattgccctgacgccaagtataaatggctgatcaataacctgccttaataaaggatctggtggttcagcatacaagctgcgttcaaacggaagatagggggcagcaatattactctccattggtctgcctatgccatcaacaagccgcccaagtagtgcgtctccaacacgaatcttgaactcatctccctgataacttaaccactgaccacagtacatgccggaaacatgctcaaaaggcaacaagaaaacctcatcttcatcaatagcgatcacctcggctaaacgttgactgggttctatcttataaaaggcgccaatacgcgcttttggtaaacgcgccttaataatcgtcccgccgatattgataatcttgccttcatatctggtagacgaatttaatgataatgccggcacagtgctattgagcactttctgaatacgtgggtatttttccaatacagaatcatgctctgaaatcatttaccgttcctaatactttaagttcgatattattcccaacctcctgaaaagagagcacggggactgacgggaacgaaccttcaatcattttcttcacatagcgcctgatatctaaagcggtcagaatgacgccgttccccgttggattcatgatattttttaagaagccaattatctgctcagttcgctccggtgagatattcagatacgaacctgatgacgtttgtctgatcgactctcgtagctcattttcaatatcagagccaataagccaaacgttcagaagtgtaccgctaacgctatagcgacctaaaatatgccgacgcagggcaatacgaacgtattcgcacaagataaccacatccttttcttttgttgaccaaaaaataagcgtctcaaagatagttctcaggtctctaattgagacattttcctctacgagacgttgtaggatgtcaacaattttgctcaaaccaagctggcgctgcagctctttcacaagctcgttatattttctctccatgatgtccatcaaataacgcgtttcttgtacgccgatgaactctttggcattagacaatacaagtttctttagcaaaaacgttatcttatcatttgttgttgcataaacatccatacctgtaaggtgagcgagctgttgattagtcttattcgtcttatatacgatagagttagtcgaaagcttttcctggacaaattcgaatgatatctctgcatgcccagcctcaaaatagacagtatcatctataagagtatctttgtatattgactcttgatagagcaaaaattctattgcgctatcattatttttaaccggattaacaataatcttaggcaatggaattccactttcctcaaagaaattccaacgcatgacctcaatttgctgtgtaatgtctgaactataaatattactacttaagtttaaaatcaatggctcagcgcccggtgagatgttttggctattagacaaatcagctcccatagcatccttattattgccagttccaaatgttcttttcttctgtaatttccaggctatccccaacaggcaaaccgccagaaataagaagaccaatgcaggaaagcccggaataatcgccattacgagcattagtgcggcactgattaaaaaagggcgactattaacagaaacctgttgaacaatatcacctgcaaggttttcttctttttcgctttcaccgggcacacgagtaacaaccacgcctgcggtgacagaaataataagcgcagggatctgggcaaccaaagcatcaccgacagacaatacagaaaacaggctaagtgccgcactaaatggcatgtcaaattgccacataccaatgagcacgccaccaaaaaggttaactaaaacaataatgataccagcaatagcgtccccttttacaaacttcatcgccccgtccattgaaccataaaactggctttccttttgcactcgggagcgaagaacttttgcctcaagcgggtcaataacgcctgcgcgcatatcaccatcaatactcatttgctttcctggcataccatcaagggaaaaacgagcactcacttcagcaacacgctcggccccttttgtaataaccataaattgaacaatggtgataatagtaaaaataaccaggccaacaacaatattaccgccaacaacaaagttaccgaaggagtaaataatgtcacccgcatcgtgatgcagcagaataagtctggttgtactaacactgagcgacaggcgcatcaacgtcgtaatcaacaggattgtggggaaagaagttagttcaagaggattttttatatagattgagagcattaataaaagtaaagctgtcgaaatattaatcgcgataatgatatccaccacaactgttggtagtggaataatcatcatcattacagccataaagaagaagagagccagaataagatcgtgatatgactctgcttttttaaatatatttaagagtttattcatgatgtcatcctgcgaacgcgctcaataatctgcacatgctgttgaaaagtattcattagaaaaaaaacatcgatattggttaacaaacaacttaagcacaatttattatcgtagacaaaaatatgttcaatcactccctgcgtacgctcaggagcaagggcactaaagaaagagaaaaatgcgttttcgttatactctaaagcaaacgtaacaaaaacattattatcaattatttcaataaaaaaagaaaacccattaaaatcaatttcaacacggttatcaaataaataaaaatcatttcccaataatcttaaaaactcttcaacgtttcttttaactaaaagattcatctgcaggctctgaagtaagtatacgtgtgaatattattgcttgaaaaagcgtattggataatatatacagtatatgtactttatgtacattgcaactatttaaataatataatagttgcctatgggataatttggttatttataaccaggtaaatgtctaaattagacaaaaggagaaagatcaatggaagcagcaaatttaagtccttctggtgcagtaatgccgctggcgacctcactcagtggaaataactcagtggatgagaagacaggagtgattaaaccagaaaatggaacaaatcgcaccgttagagttatagccggattagcacttaccactacggctctggcagctctaggtacaggtattgcagcggcatgctcggagacgagcagcacagaatacttagccctgggtattacttctggcgtactaggtactcttactgcggttggcggtgcattagcgatgaaatatgcctaaccggcccatcgcataaataaaagatagaggtaatggatgtattatgcccttgcctctttcataaaaagaggctaacagtaaatatgaacaacattaatcaatcggaaaacattaatattcaattaaataaagcgccccaaacaaatttcgttgatgagcatacctcgttagcctcagccccctctgcggcaggtgcggctcagtttcttgatcaattactccctaaaacagcgggagtgtcttctccagaacaagtgttgattgaagaaattaaaaagagacatcttgcaacaatgaacagcgatctcagtttcgatgctctatctgcaggtgggctctcgccagaagacgtgctcaccttacaaaagaatgtgctcaacgcaaacgtcaacgttgatgtcgtatctaagttagcaagcctcctttcaacatcggttacaaaattagtttcgatgcaataaaaatgaaaaaacacattaaaaacctttttttattggctgctatttgtttgacagtggcatgtaaagagcaattgtatacaggattaacagaaaaagaagctaatcagatgcaagcactgttgctatccaatgatgtcaatgtttccaaagaaatggacaaaagtggaaatatgacactcagtgtggaaaaagaggattttgttcgcgcaataacgattttaaataataacggcttcccgaaaaagaaatttgcagatatcgaggttattttcccacctagccagttagtggcatcgccatcacaagaaaatgcaaaaatcaactatctcaaagaacaagacatcgaaaggttgctaagtaaaatacctggtgttatcgattgcagcgtttcattaaatgttaacaataacgaaagtcaaccctcctcagcagccgttttagtcatcagctcgccagaggttaacttagcaccatcggtcattcagataaaaaacctagttaagaatagtgttgacgatctcaaattagaaaatattagtgttgttatcaagtcatcctcaggacaggacgggtaatatgtatgaacaataataatggcatagcaaagaatgattgtgactggctaacggcccttgattttgtaaaggatgtcaacggttcaccaacgcatctcactttttatatctaccaaaaaaatgctttcttgcacgattttggaaactactgggttctatatattgagcttagtggtgattttcgtcaggttccaacagatacatttatcagactctgcaatatcctggccgttagtaacgaatataaacaaatgggtattttcctgtctaataagaagtggtatctttgccaaatttttcataaagataataatcatcgcgcaaacatgtcaaaagcaataatgcaacatactctcgcctctttgctcgataagcaatttgataaactagagcaattatcttcatcggatacaatgatgccgccaacacacttgttttctgatataggacgaattgtgtaatgaaaaaaataagtttttttatttttacagcactattttgctgcagtgcacaagctgccccgtcctctctggaaaaaagattaggcaagagcgaatattttattattactaaaagttctccagtacgtgcaatccttaatgactttgctgctaactacagcattcctgttttcatcagtagttccgtgaatgatgatttctctggcgaaataaaaaatgaaaaacctgtaaaagtactggaaaaactgtccaaactatatcatctcacatggtattatgatgagaacatcttgtatatttataaaacaaatgaaatatcaagaagtataattacaccaacatatctggatattgactcactgctaaaatatctgagtgatacaatctcagtaaacaaaaactcttgcaatgtgagaaaaattacgacatttaactcgattgaagttcggggtgttcctgaatgtataaaatatattacatctttatcagaaagtcttgataaagaggcacagtctaaagccaaaaataaagatgttgttaaggtctttaaactgaactatgcgtcagcgacagatataacatacaaataccgtgaccaaaatgttgtcgtcccaggtgttgtctccattctgaagacaatggcaagtaatggttcacttcccagtaccggtaaaggtgccgtcgagcgaagcggtaacctgtttgataacagtgtaacgatttccgctgatccacgtcttaatgcagttgttgtaaaagaccgcgaaataacgatggatatctatcagcaattaatttctgagcttgatattgaacaaaggcaaattgaaatttctgtctcaattattgatgttgatgcaaacgatcttcagcagctcggcgtaaactggtccggtacgttaaatgcaggacaaggtacgattgcctttaatagctctaccgcacaggctaatatcagctcttctgtgataagtaatgccagtaattttatgattagggtgaatgcgttacaacagaactcgaaagctaaaatactctctcagccttcaattataaccttaaataatatgcaggcgattcttgataaaaacgtaacgttttatacaaaagtctccggagaaaaggtggcgtctctggaaagtattacaagcggaacattgctgagagtgacaccacgtatacttgatgacagctcgaatagccttaccggaaaacgtcgggaacgagttcgtttgttacttgatattcaggatggcaatcaatcgactaaccaaagcaatgctcaggatgccagcagcaccttacctgaagtacaaaattcagaaatgacaacagaagcgacattaagtgcaggagaaagtttattacttggcggatttatccaagataaagaaagttcaagtaaagatggtataccgctgttaagcgacattcctgttattggtagtttattctccagtacggtaaaacaaaaacatagtgttgttcgactctttttaattaaagcaaccccgataaaatctgcatctagcgaataataaatgaggctttatgagcaggaaatttagctctctagaggatatttatgatttctaccaggatggtggcacattagcgtcattaacaaatctgacacaacaagatctcaatgaccttcattcttatgcctatacagcatatcaatctggtgatgttataaccgcaagaaatctattccatttgctcacatatctggaacactggaattatgactacaccttatctctgggcttatgtcatcagcgtttatcaaatcatgaagatgcacaactgtgtttcgcacgctgtgcaactttagttatgcaagatcccagggcatcttattattctggaattagctacttactcgtcggaaataagaaaatggccaagaaagcctttaaggcttgtttaatgtggtgtaatgaaaaagaaaaatacactacatataaagaaaatattaaaaaattgttaggtaatacagagtaaaaactaccatcagctataccaatccccaggctgactggggattttctatcggaaataataaagctgctatagtgaagtgctcccaaagttgagcaccgaccactggtagatttatctacaggtgtggggttattccattaaccaggagtttatgccctgaactatcttctgctgtatttaatatcatttccgtttatgaaacaatcagtatatcttaacttagcattagaaatctgatctttccaatcatctatagctcagagtatatttgtcaggaaatgaccttcaaactttagccgagaaaaaggcttaccctggaaaacaaaacccttaaatatagctttatttttattcttctataaaatatactcaaaaaattacgtctaactctcctttttccgcctcatgatcatttcgttccagatattagactgtcccacaataccattaccaactcggtaggtttttctttttggtccggttgttccaggactttctatcggaaccgcctcaaggttaacatcataaatgaaaatctcaaggcgcttataatgcaaattaccataactaacatatctgacacgaaatgaaattttttcttttcttctcgatatataagttataataaatgatgctctcctcaggtttataccgaatgcttcggcaatatcattgcgagaaatccatttctcctgcaatttacaccaaagagaaaccaagatatacagaggttcaccatcgtaattctttactgagtcaggaattacatagtcgccatttttatttttagattccattttccatattctttttatttgataaataaatcgacataaaaaacatacataaaattattttaaataaacttgtggcattcctgtgtttttaataactaatggttctataaatttggcataaacatcaacaaacaatttttcatttcctcttacatggcaatgtaatgtgagattattatcattactcagtacttttttagggataactaattgataatcttgttcaatgtttagcaccgagggaatttcgtaattatatcgatggacatgaagtatgatgtcctcatcttcagagaggaccccctgatacacagaagcaatatcgccgccagtgatcatatttccatttttaatcagtataccttccccacaggagtcttcattgctaataaatataatgctatagatgccatccttcataatcataactcactcagtttcatactaacctcactcctttcaatttgttctatccataagcaatatcaagaataatggagacctttctttttctccagattgcaatgtaatatatcattaaatatactcatgtttcaacctgctgtttccctggttaacatatgtaatttctgattaataatattgagtaacaacgtaaaaatgaaaaaaataatactgagcatcattctcatttcaaattactgttatgcttccgattgttttgaaattacaggaaaagcatataacatagatccattaatattaaaagcaattgcatggaatgaatcaaaatgcaaaagcggaataaaaagcaaaacaaacaaaaacggaacgtatgatataggtataatgcaaattaattcatctcatttagatttattaagcaaatttaatatatctgaagatgatttattgaatgatgcctgtataaacatatctgttgctggttatatcttagcctctaacataaaatccagagggaatacatgggatgcagttggtgcgtataatgcaggttactttaatacaccaaatgcagtagaactcagaaggcaatacgcaatgaaaatatataaaacatataataaattaaagaataatgagcaaattatcgattaataatcaaggtctatcgcaatacgaatcaattgtgccacaggttcaaaaaagtcttctgttatatattgtcctttatgtatattcttatagagagttcttgctaaaggaatatcttcaatcactggaatatcatagagttcagccagtttaatgatctgtagagctttggcatcttttcctgtttcaataactaaaggtaatggagtctccccaagtttatagtataggcaaatcgcaatgtgagtcgggtttttaacaataacggttgattttttgatgttattagccaaacttccactttgtatctcggaatgaaggcgacggcgctcccctttaatttcagggttaccatcagtatccttggcttctcgtttcacctcatctttactcattttcattttcttcagtccctcatgcttctggaaccagaaatcaaatactgaaaagagtagatatccgaatagcacgcctttccataaaagaaaaacaaaaaaggcaacaacgacaagagcttgatatgcgttcagtcctgtgaaattagcaaactcatttgcatatgaatgccccataaaataaaaaatgagaacaattatcactaacttaaatactgatttaagtagctcaaaaatgctctttacagaaaaaatatttttcaggttattttttacactaatcttctgagccgatggttttattttttcaaccgcaaagatgaatcctatttgtgatacaccagtcgtaacagttccaacaaagacaatcaaagaaattggcaaaatatataataaaaatatatttaataccgcacctaatatttctcgaatggcatacaaaaacggtctatttagcgagtctattgtcgtattaactaatccaactatatcaacaaaaaaactcatgccatataaagaaaaaaatgaaaataagattaatgactgcactgcagccattacctcttcactttttgttacatcgcccttcttttttagatcccttagttttttgggtgtgggcttttctgttttttcactcattaatcatgctcggtaacgatctatcaattatgtcagaatgaatatttgccgtaataaaatcaggaaaaacatgaataactaatagcaatataaagattgctatcaaactttttactggcagtgataatgtgaatacgtttagctgaggtgctgttttgttaagaaacccaaaccccatatcacataagaatataccgataatcatgggaactgaaaatgataacatcagtttaataaatgaatcccatagagaaaacaaaaaatctattaaagcacgattgaatgcaatatcggcttgtaatggtaatatctcgtaggataaatatagcttatctaggatgctttgtatcccaccatgaataacaaagatcacagagataaattggtacaagataacgccagtgatagaagatgaatcacttatggacgggttaaaaattgaagatattgttgagcctcttagagtatcaataatctgtccagccgcatctattgcccaaaaaagaatagtaaatgataacccaatgaaaaaaccaatacttatttcttttagcgctattcctgtcaactgaaagattccagatggcaatttttccgaaaatgtatagttctctactatgatcggaagcgtaaacgcaatcataattgagttgcgaataaagttactgagtaaaacacctgttgaaaatattggtaggataataaacatccccagcggcctgagtatacaataaaatgatgatactatgaccgtcattatctcattcattagccgttcaccttcggaatcatttcaaatattatcgacgagaagttgatgattgttgttcccatccagtgataagtcagggcaagcgtagcaaacactgctattatttttagcaaaaaaggcaatgtttgatcctgtaactgcgttatagcctggaccagactaataataataccgataacagaggccgctatgactgtaggcaatgagaggataaatattatccagaacgtttgcacacataattgaacaaaatatccagtatccatcaattcaccaccaacagaaattcgaataatttttgccagcctccaacaagaatgaataataagatcttaaaaggaatcgaaattgttactggcgataccatcatcatacccaaggccaataagatattggaaatgatcaaatctatcgcaataaagggtaaatagagcaaaaaacctatcttgaatgcagcttcaagctgccccatcgtgaaagccggtaacagtataaatagagagtctttttttaagatagtttcattacccaattttttttgagctgcacgttcaaaaaactctacattgtctttctctgtatttttttctaaaaaaccgcgatatggtgataatattttctcatcaactttttgaaaaaaatcagagtcggtataattgattggttcctgagaaatattatcatttatctgtaatattatcggagacataataaacattgtcagtatcaaagacactgatgttagcgccatgtttggtggtacctgttgaatgcctaatgcgttcttcaatatccccagtacaatagaaattttcaggaatgaagtaccaataacaacaaatattggcagtaatgataacagaaaaaatacaataattaaaaatattggctgtgagccaatggtcattaattgagacatatcatcattcctgaataatgctaagataattatctttaaatgaattcaataaaatacttatttgctctaatgggtctaaagttattctaatatattcattttctattataattttattatgcggtgtgtttgcatcattaataagctgtatattgttggcctcgccaggatcaagtttaatgtctgggtttttagtgatcttaatagctccgacaatattgttattagatagagtttcccttacaacttcattaagtaaatcatcccaattaattcttgatgatgtatctaaagaatgtaatgcattagtcagtgacaaatgaatcttattcattatgtcctgcattaagaccaactcgatagcctggatatctttaacccattttatcgattggttaacctctttatctaattttattttattattttttcgaatcctttctctcattagaatcatttttctggcaattttttttctggattctgtctttaattctttcgatttcctcctcgccctcagtaaatgttcatatgttttttttcgagccagtttgataatatcatcagattgaataatttcctgtaacttatcctctggtatgatatcttctgtaagcactaaatcaatttttatatttttaaattcataaagtttcataaggcaataaaattttattaagtctgttaagaaataaatcattaatatgagttggttttatttctccacttttcggcaaaagatatttgactatggtccataaaggattatcagcaaatagccactccaaatttcctgcaccgtattttattaactcagcacaaaaccgttcttcaccatattctggtttacattgccctccctgccaatagaatgataactgcttcacattttgatatcctatctctctaatcagagtttctcgatataatcgtgagaaaatataatcagggcattgaatgtcaaataatgcactacttagagcaagcaatcttattttcccaattgactgatataaaaaaccttccttatttatgtcagataattccacaccagaaattttatcatgtatttcctgacgcaatatcttattgagttgattacgagtagaactagtttctcttaaacgccgaaaactgacctgattgacaccggttaaatcacctagccattcatcatgaaccatcatgattggataattaattaatttataatagttatagtctattttattaaaaattgtcatactatttttctattatttctattccgttgattcattgttgattggcttttagatcttgctggactcagtgtctctattagtttttcaatcttacttagggcagaatcatataattttcgctcttcaccatatgtgtacccctcaattaatttgtttaatttttctgccgcctgaggatctgtttttgctttttcacttaactcattaacgctttcttttacgacatcaaattcggcgattattttttttatcgcctcaatttctgatcttatttttttatctaatagttctttatttcttgtttggctcacaatactcatcctctatttattattaatcctgattcgcattatctctatagtcctaattgccgcatcacacgcaatgagcagttcctttgcttcattgtaggtaactttatccaaagggtgtttcattttttcatggatttcgttctttttgtcgtttattttttcaataaaaacatttgcggcttctttattttttattatttcatcttccagctcagttatcgttatcatttaattatttcatgttaaatatttttcagcggtattatttcttcttcagtgtccttcacaagaaaatcttctttcttcattccattcaacagtgcttctttaagccagcgtggctgtcggcctacgcccgaccaggtctgcccttcttcattgcggtagtaaacacctttcgatgagttccggcgagcgagtccatcatcaggcacattagtatatcccagctcttgtaaggttatattgtaataagtaatctgcttctgaatcgactcaattacactttgaacttcctgctctcgcagtcgctttgcttcctgctgtagaactgcaatttgctctataagctgaatgtatggacttgttgtatgtgaattattttccatattcataataaataatctccgcatgctttaatattttaagctattagcgaccttatcaggaaggaccaacaattaatcaaatgatataaattatgtgagataacgtttatctatcaaattaggacacatctatttcatcaaacaaccaccttaaaatgttattattctcttttttctaatgtgtaaaatacattatcattaaatgtcaacaaaaaaatcatatatttttaaaatccatttaaaatcaatgatatagaagaaaatcatctcgttaacaaacgactttaataattgcatttccatttagttaagcgtttctctttataagatagatctcattgcataaacaaataaaacagaataaaaaccaagctgaaccgtttcactatactctacttaattcgagttacaggaaggcggcaagcgagtgaatccccaggagcttacataagtaagtgattggggtaagcgaacgcagtcgcagcacatgcaacttgaagtatgacgagtatatatatctattagctgtttcccggacataagctacagccagcactaacctggaacgggtgcattataaaaaggaacaagggacaaatagctgaacagtaaccgcgttagtctcttcccgcataaccgtaccattcgtattaagaagtattgcccatatccattcggcgaaagaggatctgccatacatcaagtccgttttacttggcatcagatcatcgccgtcattaactctgttaaagtcggacaaacgattagcaagatctgtgattcaaaagtgcttagcgctaaggtgggactggttacagattcattaaccctgttctttgtcgcacctatcgatcggtgtaatgccacaacaggtttatgttaatcagaacaatgcgcccctctataaagagaattctttgataaggcaacttgaaaagggaaagctaactgatatcaatgtaccactttagtaatcatcacattatatacaggccaaaataagtttcctgaaagccagtatctctaaatcaatcattaatgatatattttatcgtcacaataaaaaattatctaaattctattacttatgtaaataagtacaaccttttcatagacacaaaaactatggctgacgcatcacttgcaatcaattatccatcattagattaatattttcacttatttttcagaaggtaaaaataactttctatgcgtttaaaacacccgctataaatatcttgtatattattgacactatatgatgctatatgatacttgttgccaaattgttcattacaaaccagataggagaatctctcatgataaatggacttaataatgactccgcatctttagttttagatgctgcaatgaaagttaattctgggtttaaaaaaagctgggatgagatgtcatgcgctgaaaagttatttaaagtacttagttttggtttatggaatccaacgtacagtcgtagtgaaagacaatcatttcaagagttgttaaccgttttagagcctgtatatccacttcccaatgaattaggcagagtatctgctcgtttttcagatggttcatccttaagaatttccgtcactaacagcgaacttgttgaagccgagattcgcacagcaaataatgaaaagattactgtgctcctggagtcaaacgaacaaaataggttattacaatctttacccatcgatcgccacatgccatacattcaggttcatcgtgccttatctgagatggacctgactgatactacctcaatgcgcaatctacttggttttacgtcaaaactatcaacaaccttgattcctcataatgctcaaacagatccgctttccgggcctacaccattcagctctatctttatggatacatgtcgaggactcggcaatgcaaagctttcactcaatggtgttgatatacctgcaaatgcacaaaaattgcttcgcgatgcactaggacttaaagacacacattcatcaccaacccggaatgttatagatcatggtatttctcgccatgatgcagagcaaatagcaagagaaagcagcggcagtgataaacagaaagctgaagttgtggaatttttatgccatccagaagcagcaacggccatatgctcggctttctatcaatctttcaatgtgccagccttaacgttgacacatgaaaggatctctaaagccagtgaatacaatgcggaaagatcattagatacacctaacgcttgcattaacatcagtatctctcaatcatcagatggaaacatttatgttaccagccatactggggttctgataatggcgccagaagaccgccccaacgagatgggcatgttgacgaacaggacttcttatgaagtgccgcaaggtgtgaaatgtataatcgatgaaatggtaagtgcgctacaaccaaggtatgccgcatctgaaacgtacttacaaaacacttaaaataaaactttattaatcaaaactaataatagaaaccacacccataattattaacaatttattccgaagttaatcacaattaaacaaagatatttattctgcaaacaatttacagcaaatagagaaaatgaaaagaaaaccattgattgcatttttcatcgcgatatttattgcactaaccatattaatattatttccatttaattgtacttacaaaaaatcacctcaagaacactcactttcatttataaaacaattaccaaatacggtgaacttatcatctcttacttataataaagaggatgatttcctgtatgccacccagaatagccctgcacagctacttaaaataaccaaaagtggcgacatcatggacagagccccactgccttttatctctgatgccgaaacaattgaacacatacaagggaacatttttgctgcagtagacgaaaagacttctgaactattcttttttacagttacaaaagatatgcatatctcctttcgaaataaaattcagttagaaaaattcaataaaaagaatagagggtttgaagggctggcatggaaagcagatgatcggatgctgtttgtcgcaaaagaaagacgcccaagtaaaatatttatatatcaactttctccagacctgctgagtgtaaagcaagcaactattccagaggcactaaatgatatacgtgttaacgatatatccggcctggcctttaataatgaaagtctgatgattctgtccgatgaatcgcgtaaattactcaagtttaacctgacagagatgtctttcattgagatgcttgacctgacaaaaggaaatcattctctgaccagtgatttgccccaacctgaaggaattgtaactctgcctgatgaaagcatttatgttgccagtgaacctgatatcctcgcgaaatttgtccctaataagtaagtctgtcactggccttattatttatcgaccaaacctggcaatctcataaagttataaaaatacgagtataatttcacgctaaataaacacattaatagttgaaaaggatatcagttattatcaaccagaatcttactcagtctattagtattatcagacttatattagatcctacaatatatttaatttgtatgcagaatagagtgttcacaccacatctggtatagaaaagcacaggctagcaaaaacctgaataaccccgtacttacggagttattcaggttaaaaatatccataacatcacttctgatttttattgcttacgacggatataatttctctggtcagctactaatatcatcatgctcacgcgtttaatcaaactcgtgtttctcaaacggacatcgcgggacaatcttctgcttctcccggcgcattttttaccaccttcgctacctgcattttgagcggaagatccgcttttttctggcccccgcacatatgcaagtccagttttaaatttatcctttatttcattctgaaacaaactgctcataattttctccagtggaacctgcatctcagggagacatcactacagaatacttccccttatgcactgatttaattttggtcatttagaataacggcctgtaaagtctcaatgcaacagatgggtaacgctattatgaggatcctcgtcagtaaattactggcaaggcactccgataaataagaataggttccgcaacaacgttatatgcaaatacctcacgcttcggctagattatcgccggctctgttgacgaaattatggttgaaatctggagctaccacacgttgttctggctggcgatagggatgttgggtattgcaatgatttgcttgctgtttattaaagatatttagctcaccagtctgggctaagaaaaatcggcgtggcgcaaactgagccatcctcgccatttttgctatcatgcctgcatacataaacgacaaaacagtatgcagagggaaaaatgggttccaccagaaaggggatgctgaacgttctgattgccgccgtgttgtggggaagttcaggggtctgcgcgcaatacatcatggagcaaagccagatgtcgtcgcagtttttgactatgacgcgtttgatattcgccggtttgattctgctgacgctatcatttgttcatggtgataaaatcttttctattattaacaatcacaaagatgccattagcctactgattttttccgtggttggcgcgctaaccgtacagctcacttttttgctaaccatcgaaaaatcgaacgcagccacggcaacggtgctgcaattcctctcaccgactattatcgtcgcctggttctcactggtgcgtaaatcccgcccgggcattctggttttctgcgctattttgacatcgctgatcgggacttttttattggtgacacacggtaatccgacgtcattatcgatctctcctgccgcgttattctggggcattgcctcggcatttactgctgcattctataccacctatccctcaacgctgattgcccgctatggcacgttaccggtcgtcggctggagtatgctcattggcggtctgatcctgctgcccttttatgccggacaagggacaaactttatcgttaacggaagtttgattctggcgtttttttatttggtggtcattggtacgtccctgacatttagtctgtacctgaaaggatcc

SEQ ID NO: 262 - DNA (genomic), 1047 bp; double-stranded, linear
atgctaactccatacaaaagagctgatgtagaattcgaatggattagtgatctagaagaacagggttgtttttcaaaagtatatctggctcatgacagacacctagctcatgacttggtgattaaagaaatagaaaaaaaagaaaacactaaccacgacgactactttaatgaagcaaggcttctctataaacatgcacatccaaatattgtgcaagttcagtatgctgctcaatgtgagagcaatatctatatagccatgccattttatcataatggttcgctaaaccaattaatgaaaaaaaataatcttacaagcagggagataatacggtattccattcaatttttaagtggactttatcatatacactcaaaaggtcttatgcattttgatataaaacctaataacattatgatatcaaacagaaatgaggccatgctatctgactttggattatctcagttagtcaatgaggaatcgagagctgcgcctgagtttggatatcattttcatgtgccaccggaatatttttctttatcaacaaatgattataatttcacatatgacatatatcaggcaggattaaccatatatagaatgtgtgttggacatgataattttgaaagagaaagatctgcatttagcacgattgaacaactcagagagtcgataattaatggctgctatccattaaaagagtatcctccccatatacataaaaaattaataacaatagtgaacaaatgcattcatgtagatccaaatgaaagatatcaatccgtactagatgtactaaacgatctctcagctataagtgatggcgttcttgactggcgtctacagatgacgaaaccaactaacggcacatgcgaatggcaaaaaaagtctggggacgctatactgtctatagtttttgacgcagaaaattcgtctactactggttttcgtttatacgatgatgggcggaaaaggcgtgctacgaacttaacaatatcctcaggatgtacccctacaaaactgtataggttattaaaggataactga

SEQ ID NO: 263 - protein, 348 aa
MLTPYKRADVEFEWISDLEEQGCFSKVYLAHDRHLAHDLVIKEIEKKENTNHDDYFNEARLLYKHAHPNIVQVQYAAQCESNIYIAMPFYHNGSLNQLMKKNNLTSREIIRYSIQFLSGLYHIHSKGLMHFDIKPNNIMISNRNEAMLSDFGLSQLVNEESRAAPEFGYHFHVPPEYFSLSTNDYNFTYDIYQAGLTIYRMCVGHDNFERERSAFSTIEQLRESIINGCYPLKEYPPHIHKKLITIVNKCIHVDPNERYQSVLDVLNDLSAISDGVLDWRLQMTKPTNGTCEWQKKSGDAILSIVFDAENSSTTGFRLYDDGRKRRATNLTISSGCTPTKLYRLLKDN

SEQ ID NO: 264 - DNA (genomic), 1560 bp; double-stranded, linear
gtgagtgttgttgtttcggggacgctgaaatctcctgatggtgaggcgatatcaggagcaaatattaccctgacggcgctgacagtttcaccggatgcgctcagcggcaccagtgcgtcggcagtgacccgtgaaggtggatattacggaatgacgatggatccgggggagtatgcggtttcggtgacggtgaaagggaagactgctgtctacggacgtgtgcgtattgaggggaccgaaagtacggtgacgctcaatatgctgttacgccgcagtcttgttgaggttagcatacccggagaactgctgacagatttccggcagatacagaataatgtggctgatgaccttgccactattcgtcgcctgaatgaagacacggcgacaaaaaacactcaggccacacagtcaaaagaaagtgcagcagccagtgcgaagagtgcatctgacagtgcaaagacggcaaccagcagggcggctgaagccggacaaaaagcgactgatgccactgaggctgcgacccgtgcagtcacagcagcggggaatgcagaggaaagctcgacccgtgccggagagtctgaaaaagccgccggagctgatgcagaaaaagccagacagcatgctgaaaaggccaggctggcgcaggagagcgccggagagatccttaagcgggcagaggctgccactgtcagtgctgaagaggccagacgtatggctgagaatgcacgggggccccgggggcctcagggagaaactggtccgaagggggatgtcggtcctaaaggcgaaacaggtccagtgggccctcaagggcccgcagggccgaaaggtgagcgtggtgacgttggtgctcagggggctgtagggcctgctggtccgcgtggtgagaagggcgaacagggggagcgaggaccgcagggaataccaggcctgaagggggataccggagagcgggggcctaaaggggaccagggggatatggggccaaaaggcgagaaaggtgatccgggaggtcctgcaggcccgcaaggtcctaaaggcgaacgaggagaagccggaccacagggaccgatgggagcacgaggtgagcgtggggagactggcccccgaggtgaacctggtcctgcaggtccgagaggcgaacgaggagagaccggacctcagggacctcgtggagagccaggtccggcaggcagcgctgcaaatgtggctgatgcaacgacggcacagaagggaattgtgcagttaagcagcgcaacggacagtgatgatgaaacgaaggctgccaccccgaaagcggtgaaagcggcaatggatgtggcaaatgaagcgaaaacaaaggcagaagaggctgcagcaggaggtggtgttcccggtccgaaagagataaaggggacacggggccagcaggtccggctgggccgaagggtgataagggagagcgcggtgacaccggccctgtcggggcaaccggcgaacggggaccggcaggtgatgctggtccggcaggcccgcaggggccgaaaggtgacaggggagagcggggagagaccggtctga

SEQ ID NO: 265 - protein, 519 aa
VSVVVSGTLKSPDGEAISGANITLTALTVSPDALSGTSASAVTREGGYYGMTMDPGEYAVSVTVKGKTAVYGRVRIEGTESTVTLNMLLRRSLVEVSIPGELLTDFRQIQNNVADDLATIRRLNEDTATKNTQATQSKESAAASAKSASDSAKTATSRAAEAGQKATDATEAATRAVTAAGNAEESSTRAGESEKAAGADAEKARQHAEKARLAQESAGEILKRAEAATVSAEEARRMAENARGPRGPQGETGPKGDVGPKGETGPVGPQGPAGPKGERGDVGAQGAVGPAGPRGEKGEQGERGPQGIPGLKGDTGERGPKGDQGDMGPKGEKGDPGGPAGPQGPKGERGEAGPQGPMGARGERGETGPRGEPGPAGPRGERGETGPQGPRGEPGPAGSAANVADATTAQKGIVQLSSATDSDDETKAATPKAVKAAMDVANEAKTKAEEAAAGGGVPGPKEIKGTRGQQVRLGRRVIRESAVTPALSGQPANGDRQVMLVRQARRGRKVTGESGERPV

We claim:

1. An isolated DNA molecule comprising a nucleotide sequence identical to at least twenty-five continuous nucleotides contained in DNA sequences selected from the group consisting of SEQ:ID:NO:38, SEQ:ID:NO:57, SEQ:ID:NO:63, SEQ:ID:NO:166, SEQ:ID:NO:174, SEQ:ID:NO:191, SEQ:ID:NO:195, SEQ:ID:NO:213, and SEQ:ID:NO:240.

2. A recombinant DNA construction comprising the isolated DNA molecule of claim 1.

* * * * *

UNITED STATES PATENT AND TRADEMARK OFFICE
CERTIFICATE OF CORRECTION

| | |
|---|---|
| PATENT NO. | : 6,365,723 B1 |
| APPLICATION NO. | : 09/453702 |
| DATED | : April 2, 2002 |
| INVENTOR(S) | : Frederick R. Blattner et al. |

It is certified that error appears in the above-identified patent and that said Letters Patent is hereby corrected as shown below:

On the Title Page [62] and column 1, line 3,
Please delete the paragraph under the heading "CROSS REFERENCE TO RELATED APPLICATION," and insert the following:

--This application claims priority from US Provisional Application Serial No. 60/110,955 filed on December 4, 1998.--

Signed and Sealed this

Thirty-first Day of July, 2007

JON W. DUDAS
*Director of the United States Patent and Trademark Office*